US012612605B2

(12) United States Patent
Voladri et al.

(10) Patent No.: US 12,612,605 B2
(45) Date of Patent: Apr. 28, 2026

(54) CARBOXYESTERASE POLYPEPTIDES FOR KINETIC RESOLUTION

(71) Applicant: Codexis, Inc, Redwood City, CA (US)

(72) Inventors: Rama Voladri, Pleasanton, CA (US); Jessica Anna Hurtak, Mountain View, CA (US); Auric Anthony Sowell-Kantz, Mill Valley, CA (US); Nandhitha Subramanian, Cambridge (GB); Ericka Bermudez, Aptos, CA (US); David Entwistle, San Carlos, CA (US); Melissa Ann Mayo, Foster City, CA (US); James Nicholas Riggins, San Francisco, CA (US)

(73) Assignee: Codexis, Inc., Redwood City, CA (US)

( * ) Notice: Subject to any disclaimer, the term of this patent is extended or adjusted under 35 U.S.C. 154(b) by 666 days.

(21) Appl. No.: 17/916,510

(22) PCT Filed: Apr. 6, 2021

(86) PCT No.: PCT/US2021/025975
§ 371 (c)(1),
(2) Date: Sep. 30, 2022

(87) PCT Pub. No.: WO2021/207208
PCT Pub. Date: Oct. 14, 2021

(65) Prior Publication Data

US 2023/0159904 A1 May 25, 2023

Related U.S. Application Data

(60) Provisional application No. 63/008,061, filed on Apr. 10, 2020.

(51) Int. Cl.
*C12N 9/18* (2006.01)

(52) U.S. Cl.
CPC .................................... *C12N 9/18* (2013.01)

(58) Field of Classification Search
CPC ....................................................... C12N 9/18
See application file for complete search history.

(56) References Cited

U.S. PATENT DOCUMENTS

| | | | |
|---|---|---|---|
| 5,605,793 | A | 2/1997 | Stemmer |
| 5,811,238 | A | 9/1998 | Stemmer et al. |
| 5,830,721 | A | 11/1998 | Stemmer et al. |
| 5,834,252 | A | 11/1998 | Stemmer et al. |
| 5,837,458 | A | 11/1998 | Minshull et al. |
| 5,928,905 | A | 7/1999 | Stemmer et al. |
| 6,096,548 | A | 8/2000 | Stemmer |
| 6,117,679 | A | 9/2000 | Stemmer |
| 6,132,970 | A | 10/2000 | Stemmer |
| 6,165,793 | A | 12/2000 | Stemmer |
| 6,180,406 | B1 | 1/2001 | Stemmer |
| 6,251,674 | B1 | 6/2001 | Tobin et al. |
| 6,265,201 | B1 | 7/2001 | Wackett et al. |
| 6,277,638 | B1 | 8/2001 | Stemmer |
| 6,287,861 | B1 | 9/2001 | Stemmer et al. |
| 6,287,862 | B1 | 9/2001 | delCardayre et al. |
| 6,291,242 | B1 | 9/2001 | Stemmer |
| 6,297,053 | B1 | 10/2001 | Stemmer |
| 6,303,344 | B1 | 10/2001 | Patten et al. |
| 6,309,883 | B1 | 10/2001 | Minshull et al. |
| 6,319,713 | B1 | 11/2001 | Patten et al. |
| 6,319,714 | B1 | 11/2001 | Crameri et al. |
| 6,323,030 | B1 | 11/2001 | Stemmer |
| 6,326,204 | B1 | 12/2001 | delCardayre et al. |
| 6,335,160 | B1 | 1/2002 | Patten et al. |
| 6,335,198 | B1 | 1/2002 | delCardayre et al. |
| 6,337,186 | B1 | 1/2002 | Krebber |
| 6,344,356 | B1 | 2/2002 | Stemmer |
| 6,352,859 | B1 | 3/2002 | delCardayre et al. |
| 6,355,484 | B1 | 3/2002 | Patten et al. |
| 6,358,740 | B1 | 3/2002 | Patten et al. |
| 6,358,742 | B1 | 3/2002 | Stemmer |
| 6,365,377 | B1 | 4/2002 | Patten et al. |
| 6,365,408 | B1 | 4/2002 | Stemmer |
| 6,368,861 | B1 | 4/2002 | Crameri et al. |
| 6,372,497 | B1 | 4/2002 | Stemmer |
| 6,376,246 | B1 | 4/2002 | Crameri et al. |
| 6,379,964 | B1 | 4/2002 | delCardayre et al. |
| 6,387,702 | B1 | 5/2002 | Stemmer |
| 6,391,552 | B2 | 5/2002 | Stemmer |

(Continued)

FOREIGN PATENT DOCUMENTS

| | | | |
|---|---|---|---|
| WO | 95/22625 | A1 | 8/1995 |
| WO | 95/33836 | A1 | 12/1995 |

(Continued)

OTHER PUBLICATIONS

B0RNI6_XANCB. UniProtKB Database. Jan. 16, 2019.*
Fransceus. J Ind Microbiol Biotechnol. May 2017;44(4-5):687-695.*
Sanavia. Computational and Structural Biotechnology Journal, vol. 18, 2020, pp. 1968-1979.*
Studer. Residue mutations and their impact on protein structure and function: detecting beneficial and pathogenic changes. Biochem. J. (2013) 449, 581-594.*
Altschul, S., et al., "Basic local alignment search tool," J. Mol. Biol., 215: 403-410 (1990).

(Continued)

*Primary Examiner* — Yong D Pak
(74) *Attorney, Agent, or Firm* — FisherBroyles, LLP; Adam K. Whiting; Adelaide K. Leitzel

(57) ABSTRACT

The present invention provides engineered carboxyesterase enzymes having improved properties as compared to a naturally occurring wild-type carboxyesterase enzymes, as well as polynucleotides encoding the engineered carboxyesterase enzymes, host cells capable of expressing the engineered carboxyesterase enzymes, and methods of using the engineered carboxyesterase enzymes in hydrolysis reactions.

24 Claims, No Drawings

Specification includes a Sequence Listing.

(56) References Cited

U.S. PATENT DOCUMENTS

| | | | |
|---|---|---|---|
| 6,391,640 | B1 | 5/2002 | Minshull et al. |
| 6,395,547 | B1 | 5/2002 | Stemmer |
| 6,406,855 | B1 | 6/2002 | Patten et al. |
| 6,406,910 | B1 | 6/2002 | Patten et al. |
| 6,413,745 | B1 | 7/2002 | Patten et al. |
| 6,413,774 | B1 | 7/2002 | Stemmer |
| 6,420,175 | B1 | 7/2002 | Stemmer |
| 6,423,542 | B1 | 7/2002 | Crameri et al. |
| 6,426,224 | B1 | 7/2002 | Crameri et al. |
| 6,436,675 | B1 | 8/2002 | Welch et al. |
| 6,444,468 | B1 | 9/2002 | Stemmer et al. |
| 6,455,253 | B1 | 9/2002 | Patten et al. |
| 6,479,652 | B1 | 11/2002 | Crameri et al. |
| 6,482,647 | B1 | 11/2002 | Stemmer |
| 6,483,011 | B1 | 11/2002 | Stemmer et al. |
| 6,484,105 | B2 | 11/2002 | Zhang |
| 6,489,146 | B2 | 12/2002 | Stemmer et al. |
| 6,500,617 | B1 | 12/2002 | Stemmer et al. |
| 6,500,639 | B2 | 12/2002 | Subramanian |
| 6,506,602 | B1 | 1/2003 | Stemmer |
| 6,506,603 | B1 | 1/2003 | Stemmer |
| 6,518,065 | B1 | 2/2003 | Stemmer |
| 6,519,065 | B1 | 2/2003 | Colbourne et al. |
| 6,521,453 | B1 | 2/2003 | Crameri et al. |
| 6,528,311 | B1 | 3/2003 | delCardayre et al. |
| 6,537,746 | B2 | 3/2003 | Arnold et al. |
| 6,573,098 | B1 | 6/2003 | Stemmer |
| 6,576,467 | B1 | 6/2003 | Stemmer |
| 6,579,678 | B1 | 6/2003 | Patten et al. |
| 6,586,182 | B1 | 7/2003 | Patten et al. |
| 6,602,986 | B1 | 8/2003 | Stemmer et al. |
| 6,605,430 | B1 | 8/2003 | Affholter et al. |
| 6,613,514 | B2 | 9/2003 | Patten et al. |
| 6,653,072 | B1 | 11/2003 | Patten et al. |
| 6,686,515 | B1 | 2/2004 | Lassner et al. |
| 6,703,240 | B1 | 3/2004 | Stemmer et al. |
| 6,716,631 | B1 | 4/2004 | delCardayre et al. |
| 6,825,001 | B2 | 11/2004 | Wackett et al. |
| 6,902,922 | B2 | 6/2005 | Ness et al. |
| 6,917,882 | B2 | 7/2005 | Selifonov et al. |
| 6,946,296 | B2 | 9/2005 | Patten et al. |
| 6,961,664 | B2 | 11/2005 | Selifonov et al. |
| 6,995,017 | B1 | 2/2006 | Stemmer |
| 7,024,312 | B1 | 4/2006 | Selifonov et al. |
| 7,058,515 | B1 | 6/2006 | Selifonov et al. |
| 7,105,297 | B2 | 9/2006 | Minshull et al. |
| 7,148,054 | B2 | 12/2006 | delCardayre et al. |
| 7,220,566 | B2 | 5/2007 | Ness et al. |
| 7,288,375 | B2 | 10/2007 | Stemmer et al. |
| 7,384,387 | B1 | 6/2008 | Raillard et al. |
| 7,421,347 | B2 | 9/2008 | Selifonov et al. |
| 7,430,477 | B2 | 9/2008 | Selifonov et al. |
| 7,462,469 | B2 | 12/2008 | Bass et al. |
| 7,534,564 | B2 | 5/2009 | Patten et al. |
| 7,620,500 | B2 | 11/2009 | Mundorff et al. |
| 7,620,502 | B2 | 11/2009 | Selifonov et al. |
| 7,629,170 | B2 | 12/2009 | delCardayre et al. |
| 7,702,464 | B1 | 4/2010 | Emig et al. |
| 7,747,391 | B2 | 6/2010 | Gustafsson et al. |
| 7,747,393 | B2 | 6/2010 | Fox |
| 7,751,986 | B2 | 7/2010 | Gustafsson et al. |
| 7,776,598 | B2 | 8/2010 | Patten et al. |
| 7,783,428 | B2 | 8/2010 | Gustafsson et al. |
| 7,795,030 | B2 | 9/2010 | Minshull et al. |
| 7,853,410 | B2 | 12/2010 | Selifonov et al. |
| 7,868,138 | B2 | 1/2011 | Stemmer et al. |
| 7,873,477 | B1 | 1/2011 | Gustafsson et al. |
| 7,873,499 | B2 | 1/2011 | Selifonov et al. |
| 7,904,249 | B2 | 3/2011 | Selifonov et al. |
| 7,957,912 | B2 | 6/2011 | Selifonov et al. |
| 7,981,614 | B2 | 7/2011 | Stemmer et al. |
| 8,014,961 | B2 | 9/2011 | Bass et al. |
| 8,029,988 | B2 | 10/2011 | Crameri et al. |
| 8,048,674 | B2 | 11/2011 | Minshull et al. |
| 8,058,001 | B2 | 11/2011 | Crameri et al. |
| 8,076,138 | B2 | 12/2011 | delCardayre et al. |
| 8,108,150 | B2 | 1/2012 | Mundorff et al. |
| 8,170,806 | B2 | 5/2012 | Selifonov et al. |
| 8,224,580 | B2 | 7/2012 | Mundorff et al. |
| 8,377,681 | B2 | 2/2013 | delCardayre et al. |
| 8,383,346 | B2 | 2/2013 | Colbeck et al. |
| 8,457,903 | B1 | 6/2013 | Emig et al. |
| 8,504,498 | B2 | 8/2013 | Fox |
| 8,589,085 | B2 | 11/2013 | Selifonov et al. |
| 8,762,066 | B2 | 6/2014 | Fox |
| 8,768,871 | B2 | 7/2014 | Fox |
| 9,453,018 | B2 | 9/2016 | Dilger et al. |
| 9,593,326 | B2 | 3/2017 | Clark et al. |
| 9,665,694 | B2 | 5/2017 | Cope |
| 9,684,771 | B2 | 6/2017 | Cope et al. |
| 9,714,437 | B2 | 7/2017 | Chan et al. |
| 2003/0233675 | A1 | 12/2003 | Cao et al. |
| 2008/0220990 | A1 | 9/2008 | Fox |
| 2008/0229451 | A1 | 9/2008 | Cao et al. |
| 2009/0312196 | A1 | 12/2009 | Colbeck et al. |
| 2016/0096839 | A1 | 4/2016 | Dilger et al. |
| 2019/0177707 | A1 | 6/2019 | Voladri et al. |

FOREIGN PATENT DOCUMENTS

| | | | |
|---|---|---|---|
| WO | 96/00787 | A1 | 1/1996 |
| WO | 97/0078 | A1 | 1/1997 |
| WO | 97/35966 | A1 | 10/1997 |
| WO | 98/27230 | A1 | 6/1998 |
| WO | 00/42651 | A1 | 7/2000 |
| WO | 01/75767 | A2 | 10/2001 |
| WO | 2007/128496 | A2 | 11/2007 |
| WO | 2009/008908 | A2 | 1/2009 |
| WO | 2009/152336 | A1 | 12/2009 |
| WO | 2019/116311 | A1 | 6/2019 |
| WO | 2019/118557 | | 6/2019 |

OTHER PUBLICATIONS

Altschul, S.F., et al., "Gapped BLAST and PSI-BLAST: a new generation of protein database search programs," Nucleic Acids Res., 25(17):3389-3402 (1997).

Beaucage, S.L., et al., "Deoxynucleoside phosphoamidites—A new class of key intermediates for deoxypolynucleotide synthesis," Tetrahedron Letters, 22(20):1859-62 (1981).

Botstein, D., et al., "Strategies and applications of in vitro mutagenesis," Science, 229(4719):1193-1201 [1985].

Carter, P., "Site-directed mutagenesis," Biochem. J., 237:1-7 (1986).

Christians, F.C., et al., "Directed evolution of thymidine kinase for AZT phosphorylation using DNA family shuffling," Nat. Biotechnol., 17:259-264 (1999).

Crameri, A., et al., "DNA shuffling of a family of genes from diverse species accelerates directed evolution", Nature, 391:288-291 (1998).

Crameri, A., et al., "Improved green fluorescent protein by molecular evolution using DNA shuffling," Nat. Biotechnol., 14(3):315-319 (1996).

Crameri, A., et al., "Molecular evolution of an arsenate detoxification pathway by DNA shuffling," Nat. Biotechnol., 15(5):436-438 (1997).

Dale, S.J., et al., "Oligonucleotide-directed random mutagenesis using the phosphorothioate method," Methods Mol. Biol., 57:369-74 (1996).

De Boer, H.A., et al., "The tac promoter: A functional hybrid derived from the trp and lac promoters," Proc. Natl Acad. Sci. USA, 80: 21-25 (1983).

Ehrlich, S.D., "DNA cloning in Bacillus subtilis," Proc Natl Acad Sci. USA, 75:1433 (1978).

Guo, Z., et al., "3'-End-Forming Signals of Yeast mRNA," Mol. Cell. Biol., 15(11):5983-5990 [1995].

Henikoff, S., et al., "Amino acid substitution matrices from protein blocks," Proc. Natl. Acad. Sci. USA, 89:10915-10919 [1992].

Koszelewski, D., et al., "Immobilization of omega-transaminases by encapsulation in a sol-gel/celite matrix," Journal of Molecular Catalysis B: Enzymatic, 63: 39-44 (2010).

Kramer, B., et al., "Different base/base mismatches are corrected with different efficiencies by the methyl-directed DNA mismatch-repair system of *E. coli*," Cell, 38(3):879-887 [1984].

(56) References Cited

OTHER PUBLICATIONS

Lathe, R., et al., "Plasmid and bacteriophage vectors for excision of intact inserts," Gene, 57:193-201 (1987).
Ling, M., et al., "Approaches to DNA Mutagenesis:An Overview," Anal. Biochem., 254:157-78 (1997).
Martin, A.R., et al., "Characterization of free and immobilized (S)-aminotransferase for acetophenone production," Applied Microbiology and Biotechnology, 76(4): 843-851 (2007).
Mateo, C., et al., "Epoxy sepabeads: a novel epoxy support for stabilization of industrial enzymes via very intense multipoint covalent attachment," Biotechnology Progress 18(3):629-34 (2002).
Matthes, H.W.D., et al., "Simultaneous rapid chemical synthesis of over one hundred oligonucleotides on a microscale," EMBO J., 3(4):801-05 (1984).
Minshull, J., et al., "Protein evolution by molecular breeding," Curr. Op. Chem. Biol., 3(3):284-290 (1999).
Needleman, S., et al., "A general method applicable to the search for similarities in the amino acid sequence of two proteins," J. Mol. Biol. 48:443-453 (1970).
Pearson, W.R., "Improved tools for biological sequence comparison," Proc. Nat'l. Acad. Sci. USA, 85:2444-2448 (1988).
Rauwerdink, A., et al., "How the Same Core Catalytic Machinery Catalyzes 17 Different Reactions: the Serine-Histidine-Aspartate Catalytic Triad of α/β-Hydrolase Fold Enzymes," ACS Cat., 5: 6153-6176 [2015].
Romanos, M.A., et al., "Foreign gene expression in yeast: a review," Yeast 8:423-488 [1992].
Simonen, M., et al., "Protein Secretion in *Bacillus* Species," Microbiological Reviews, 57:109-137 (1993).
Smith, M., "In vitro mutagenesis," Ann. Rev. Genet., 19:423-462 (1985).
Smith, T., et al., "Comparison of Biosequences," Adv. Appl. Math, 2:482-489 (1981).
Stemmer, W., "DNA Shuffling by Random Fragmentation and Reassembly: In vitro Recombination for Molecular Evolution," Proc. Natl. Acad. Sci. USA, 91:10747-10751 (1994).
Stemmer, W.P.C., "Rapid evolution of a protein in vitro by DNA shuffling", Nature, 370:389-391 (1994).
Straathof, A.J.J., et al., "The enantiomeric ratio: origin, determination and prediction," Enzyme Microbio Technol, 21:559-571 [1997].
Truppo, M.D., et al., "Development of an Improved Immobilized CAL-B for the Enzymatic Resolution of a Key Intermediate to Odanacatib," Organic Process Research & Development, 15:1033-1035 (2011).
Varma, R., et al., "Lipase Catalysed Enantioselective Amidation of α-phenylethylamine," Asian J. Biochem., 2(4): 279-283 [2007].
Villa-Komaroff, L., et al., "A bacterial clone synthesizing proinsulin," Proc. Natl Acad. Sci. USA, 75:3727-3731 (1978).
Wells, J.A., et al., "Cassette mutagenesis: an efficient method for generation of multiple mutations at defined sites," Gene, 34:315-323 (1985).
Yi, S., et al., "Covalent immobilization of omega-transaminase from Vibrio fluvialis JS17 on chitosan beads," Process Biochemistry 42(5): 895-898 (2007).
Zhang, J-H., et al., "Directed evolution of a fucosidase from a galactosidase by DNA shuffling and screening ," Proc. Nat. Acad. Sci., U.S.A., 94:4504-4509 (1997).
Genbank accession No. WP_011038606.1 dated Sep. 11, 2023.
UniProt Accession No. A0A0H2X591 dated Sep. 16, 2015.
GenBank Accession No. RJU12542.1, dated Oct. 1, 2018.
Vorholter, F., et al., "The genome of Xanthomonas campestris pv. campestris B100 and its use for the reconstruction of metabolic pathways involved in xanthan biosynthesis," J. Biotechnology, 134(1-2):33-45 [2008].
UniProt Accession No. Q8P533 dated Oct. 1, 2002.
UniProt Accession No. B0RNI6 dated Apr. 8, 2008.

* cited by examiner

CARBOXYESTERASE POLYPEPTIDES FOR KINETIC RESOLUTION

The present application is a national stage application filed under 35 USC § 371 and claims priority to PCT International Application No. PCT/US21/25975, filed Apr. 6, 2021, which claims priority to U.S. Prov. Pat. Appln. Ser. No. 63/008,061, filed Apr. 10, 2020, both of which are hereby incorporated by reference in their entirety, for all purposes.

REFERENCE TO SEQUENCE LISTING, TABLE OR COMPUTER PROGRAM

The Sequence Listing concurrently submitted herewith under 37 C.F.R. § 1.821 in a computer readable form (CRF) via EFS-Web as file name, CX2-206WO1_ST25.txt, is herein incorporated by reference. The electronic copy of the Sequence Listing was created on Apr. 5, 2021 with a file size of 800 Kbytes.

FIELD OF THE INVENTION

The present invention provides engineered carboxyesterases (E.C. 3.1.1) having improved non-native properties as compared to naturally occurring wild-type (WT) carboxyesterase enzymes, as well as polynucleotides encoding the engineered carboxyesterase enzymes, host cells capable of expressing the engineered carboxyesterase enzymes, and methods of applying the engineered carboxyesterase enzymes to hydrolysis reactions.

BACKGROUND OF THE INVENTION

Carboxyesterases and lipases are capable of a variety of reactions that may be useful to efficiently produce pharmaceutical compounds and intermediates at industrial process conditions. Enzyme function and enzyme substrate scope are often malleable, as it has been observed that enzyme active sites are capable of catalyzing several different chemical reactions via one or more amino acid mutations (See Rauwerdink and Kazluaskas, ACS Cat., 5: 6153-6176 [2015]).

For example, lipases have found application at commercial scale for hydrolysis of fatty acid esters, and have also been employed for amidation of esters (Seem Faber, Biotransformations in Organic Chemistry, In *Special Techniques*, Springer-Verlag, New York, NY, [2011]; and Kalkote, et al., Asian J. Biochem., 2: 279-283 [2007]). Like lipases, carboxyesterases may act as hydrolases for desirable transformations, including the transformation of racemic ester substrates to corresponding chiral acids.

Industrial process conditions often utilize reagents and create waste that may be highly toxic. Removal of the waste from the reaction mixture may also be a tedious and expensive process. Enzymatic transformations, on the other hand, may remove several steps from a chemical synthesis process and may obviate the need for toxic reagents and produce correspondingly fewer waste products. Enzymes may also allow kinetic resolution of a racemic substrate to produce a chiral product in enantiomeric excess. However, naturally occurring wild-type enzymes may not be optimized for efficient chiral transformations at industrial process conditions. Thus, carboxyesterases with improved properties are desirable to enable efficient and less toxic production of pharmaceutical compounds and intermediates under industrial process conditions.

SUMMARY OF THE INVENTION

The present invention provides engineered carboxyesterases (E.C. 3.1.1) having improved non-native properties as compared to naturally occurring wild-type (WT) carboxyesterase enzymes, as well as polynucleotides encoding the engineered carboxyesterase enzymes, host cells capable of expressing the engineered carboxyesterase enzymes, and methods of applying the engineered carboxyesterase enzymes to hydrolysis reactions.

The present invention provides engineered carboxyesterases comprising polypeptide sequences having at least 80%, 85%, 86%, 87%, 88%, 89%, 90%, 91%, 92%, 93%, 94%, 95%, 96%, 97%, 98%, or 99% or more sequence identity to SEQ ID NO: 2 or a functional fragment thereof, wherein the engineered carboxyesterases comprise at least one substitution or substitution set in their polypeptide sequences, and wherein the amino acid positions of the polypeptide sequences are numbered with reference to SEQ ID NO: 2. In some embodiments, at least one substitution or substitution set in the polypeptide sequence comprises substitutions at positions selected from 3/4/6/9/10/11/36/38/70/82/180/200/214/229, 3/6/9/10/70/99, 3/8/9/10/11/13/70/82/107/229, 3/8/9/10/11/13/70/107, 3/8/9/10/11/70, 3/8/9/10/11/70/229, 3/8/9/10/13/70/82/107, 3/8/9/10/13/70/82/229, 3/8/9/10/70/82, 3/8/9/10/70/82/229, 3/8/9/10/70/229, 3/9/10/11/13/82, 3/9/10/11/70/82/107, 3/9/10/11/70/229, 3/9/10/70/82, 3/9/11, 3/9/11/70/82/180, 4/6/8/9/10/11/38/70/82/180/186/200/214/229, 4/6/9/10/11/36/70/82/180/200/214/229, 4/6/9/10/11/38/70/82/180/186/200/214, 4/6/9/10/70/82/229, 4/8/9/10/11/13/70/82/107/229, 4/8/9/10/11/36/38/70/82/180/200/214/229, 4/8/9/10/11/36/70/82/180/186/200/214/229, 4/8/9/10/11/70/82/180/200/214/229, 4/8/9/10/36/38/70/82/180/200/214/229, 4/9/10/11/36/38/70/82/180/200/214/229, 4/9/10/11/36/65/70/82/180/186/200/214, 4/9/10/11/36/70/82/180/200/214, 4/9/10/11/36/70/82/180/200/214/229, 4/9/10/11/70/82/180/200/214, 6/8/9/10/38/70/82/180/200/214, 6/9/10/11/36/70/82/180/200/214/229, 6/9/10/38/70/82/180/186/200/214/229, 6/9/10/70/82/180/186/200/214/229, 8/9/10, 8/9/10/11/13/70, 8/9/10/11/13/70/82, 8/9/10/11/13/70/82/107/229, 8/9/10/11/36/38/70/82/180/200/214, 8/9/10/11/38/70/82/180/200/214/229, 8/9/10/11/43/70/82/180/200/214, 8/9/10/11/70, 8/9/10/11/70/82/107/229, 8/9/10/11/70/229, 8/9/10/70, 8/9/10/70/82/229, 9/10, 9/10/11/12/49/51/70/73/82/180/200/225, 9/10/11/12/49/70/73/82/180, 9/10/11/12/51/54/70/73/82/108/148/180/225, 9/10/11/12/51/54/70/73/82/110/180, 9/10/11/12/51/54/70/73/82/148/180/225, 9/10/11/12/51/70/73/82/148/180, 9/10/11/12/51/70/73/82/148/180/200/225, 9/10/11/12/51/70/73/110/148/180, 9/10/11/17/49/70/82/180/200, 9/10/11/17/49/70/82/180/219, 9/10/11/17/51/54/70/82/148/180/200, 9/10/11/17/51/54/70/82/180, 9/10/11/17/70/73/82/87/180/219, 9/10/11/17/70/82/148/180/219, 9/10/11/35/70/82/180/200/214, 9/10/11/36/38/65/70/82/180/200/214/229, 9/10/11/36/38/70/82/180/200/214, 9/10/11/36/38/70/82/180/200/214/229, 9/10/11/36/70/82/180/196/214, 9/10/11/36/70/82/180/200/214, 9/10/11/36/70/82/180/200/214/229, 9/10/11/38/70/82/180/186/200/214, 9/10/11/40/70/82/180/200/214, 9/10/11/49/51/54/70/82/87/108/110/148/180/219, 9/10/11/49/51/54/70/82/87/108/180, 9/10/11/49/51/54/70/82/110/148/180, 9/10/11/49/51/70/82/108/110/148/180, 9/10/11/49/54/70/82/87/148/180, 9/10/11/49/70/82/87/108/110/180/200, 9/10/11/49/70/82/87/180, 9/10/11/49/70/82/110/148/180/225, 9/10/11/51/54/70/73/82/108/110/180, 9/10/11/51/54/70/73/82/108/180/200/225, 9/10/11/51/54/70/73/82/110/148/180, 9/10/11/51/54/70/82/148/180, 9/10/11/51/70/82/110/180/192/219, 9/10/11/54/70/82/87/108/180, 9/10/11/54/70/82/

87/180/192, 9/10/11/54/70/82/148/180/200, 9/10/11/54/70/82/180/200/214, 9/10/11/70, 9/10/11/70/71/82/180/200/214, 9/10/11/70/73/82/87/110/180, 9/10/11/70/73/82/108/148/180, 9/10/11/70/73/82/148/180, 9/10/11/70/73/82/148/180/192/200, 9/10/11/70/73/82/180/200/214, 9/10/11/70/82, 9/10/11/70/82/87/110/180/219, 9/10/11/70/82/100/180/200/214, 9/10/11/70/82/107, 9/10/11/70/82/108/180/200/214, 9/10/11/70/82/148/180, 9/10/11/70/82/148/180/200/214, 9/10/11/70/82/180, 9/10/11/70/82/180/200/214, 9/10/11/70/87/180/200/214, 9/10/11/70/107, 9/10/12/49/51/54/70/82/108/148/180/225, 9/10/12/51/54/70/180/225, 9/10/12/51/70/73/82/148/180/200, 9/10/12/70/82/148/180/225, 9/10/12/70/82/180/200/214, 9/10/13/70, 9/10/13/70/82, 9/10/13/70/229, 9/10/13/207, 9/10/17, 9/10/17/49/51/54/70/73/82/108/110/148/180/192/200/219, 9/10/17/49/51/54/70/82/87/180/219, 9/10/17/49/70/82/148/180, 9/10/17/51/54/70/82/87/108/110/180/200, 9/10/17/51/70/73/82/87/108/110/148/180/219, 9/10/17/54/70/73/82/87/108/110/148/180/200, 9/10/17/54/70/73/82/108/110/148/180, 9/10/17/54/70/82/87/108/110/180, 9/10/17/70/73/82/87/180/219, 9/10/17/70/73/82/108/110/148/180/200, 9/10/17/70/82/87/148/180, 9/10/17/70/82/87/148/180/192/219, 9/10/17/70/82/108/148/180, 9/10/17/70/82/110/148/180, 9/10/17/70/82/110/148/180/200, 9/10/17/70/82/180/200/214, 9/10/17/70/104/160/165, 9/10/17/70/139/160/165, 9/10/26, 9/10/29/70, 9/10/36/70/82/180/200/214, 9/10/37, 9/10/38/70/82/180/200/214, 9/10/39, 9/10/39/186, 9/10/41, 9/10/45/70, 9/10/49/51/54/70/73/82/108/110/148/180/192, 9/10/49/51/54/70/73/82/148/180, 9/10/49/51/54/70/82/108/110/148/180/225, 9/10/49/51/54/70/82/110/148/180, 9/10/49/51/54/70/82/110/180, 9/10/49/51/54/70/82/148/180, 9/10/49/51/54/70/82/148/180/192, 9/10/49/51/70/82/108/148/180/219, 9/10/49/51/70/82/110/148/180, 9/10/49/51/70/82/180/225, 9/10/49/54/70/73/82/87/110/180, 9/10/49/54/70/82/87/110/180, 9/10/49/54/70/82/108/148/180/225, 9/10/49/70/73/82/87/108/148/180, 9/10/49/70/73/82/108/110/148/180/225, 9/10/49/70/82/87/148/180, 9/10/49/70/82/110/180/219, 9/10/51/54/70/73/82/108/180, 9/10/51/54/70/73/82/110/148/180, 9/10/51/54/70/73/82/110/180, 9/10/51/54/70/73/82/180/219, 9/10/51/54/70/73/82/180/225, 9/10/51/54/70/82/87/180, 9/10/51/54/70/82/148/180, 9/10/51/54/70/82/180, 9/10/51/54/70/82/180/200, 9/10/51/70/82/108/180, 9/10/51/70/82/110/180/200, 9/10/51/70/82/180/219, 9/10/54/70/73/82/108/148/180/192, 9/10/54/70/82/87/108/180/200, 9/10/54/70/82/180, 9/10/62, 9/10/70, 9/10/70/73/82/87/108/110/180, 9/10/70/73/82/87/180/192/219, 9/10/70/73/82/87/180/200, 9/10/70/73/82/108/110/148/180, 9/10/70/73/82/108/110/180/200/219, 9/10/70/73/82/108/148/180, 9/10/70/73/82/108/148/180/192, 9/10/70/73/82/108/148/180/192/219, 9/10/70/73/82/108/180, 9/10/70/73/82/148/180, 9/10/70/73/82/148/180/200, 9/10/70/73/82/180/192, 9/10/70/73/82/180/192/219, 9/10/70/82, 9/10/70/82/87/108/110/148/180/192/219, 9/10/70/82/87/108/110/180, 9/10/70/82/87/108/110/180/192, 9/10/70/82/87/180, 9/10/70/82/107, 9/10/70/82/107/229, 9/10/70/82/108/110/180/219, 9/10/70/82/108/180, 9/10/70/82/110/148/180, 9/10/70/82/110/180/219, 9/10/70/82/148/180, 9/10/70/82/148/180/200, 9/10/70/82/148/180/200/219, 9/10/70/82/180, 9/10/70/82/180/192/219, 9/10/70/82/180/200/214, 9/10/70/82/229, 9/10/70/92, 9/10/70/99, 9/10/70/99/229, 9/10/70/107/229, 9/10/70/156, 9/10/70/165, 9/10/70/229, 9/10/88, 9/10/90, 9/10/96, 9/10/107, 9/10/110, 9/10/111, 9/10/112, 9/10/133, 9/10/178, 9/10/185, 9/10/186, 9/10/196, 9/10/211, 9/10/226, 11/24, 11/24/219, and 11/36/206/208, wherein the amino acid positions of the polypeptide sequence are numbered with reference to SEQ ID NO: 2. In some additional embodiments, at least one substitution or substitution set in the polypeptide sequence comprises substitutions selected from: 3R/4R/6P/9C/10I/11I/36N/38Y/70W/82Q/180L/200A/214W/229M, 3R/6P/9C/10I/70W/99R, 3R/8G/9C/10I/11T/13E/70W/82Q/107F/229M, 3R/8G/9C/10I/11T/13E/70W/107F, 3R/8G/9C/10I/11T/70W, 3R/8G/9C/10I/11T/70W/229M, 3R/8G/9C/10I/13E/70W/82Q/107F, 3R/8G/9C/10I/13E/70W/82Q/229M, 3R/8G/9C/10I/70W/82Q, 3R/8G/9C/10I/70W/82Q/229M, 3R/8G/9C/10I/70W/229M, 3R/9C/10I/11I/13E/82Q, 3R/9C/10I/11T/70W/82Q/107F, 3R/9C/10I/11T/70W/229M, 3R/9C/10I/70W/82Q, 3R/9C/11I, 3R/9C/11I/70W/82Q/180L, 4R/6P/8G/9C/10I/11T/38Y/70W/82Q/180L/186F/200A/214W/229M, 4R/6P/9C/10I/11I/36N/70W/82Q/180L/200A/214W/229M, 4R/6P/9C/10I/11I/38Y/70W/82Q/180L/186F/200A/214W, 4R/6P/9C/10I/70W/82Q/229M, 4R/8G/9C/10I/11T/13E/70W/82Q/107F/229M, 4R/8G/9C/10I/11T/36N/38Y/70W/82Q/180L/200A/214W/229M, 4R/8G/9C/10I/11T/36N/70W/82Q/180L/186F/200A/214W/229M, 4R/8G/9C/10I/11T/70W/82Q/180L/200A/214W/229M, 4R/8G/9C/10I/36N/38Y/70W/82Q/180L/200A/214W/229M, 4R/9C/10I/11I/36N/38Y/70W/82Q/180L/200A/214W/229M, 4R/9C/10I/11T/36N/65I/70W/82Q/180L/186F/200A/214W, 4R/9C/10I/11T/36N/70W/82Q/180L/200A/214W, 4R/9C/10I/11T/36N/70W/82Q/180L/200A/214W/229M, 4R/9C/10I/11T/70W/82Q/180L/200A/214W, 6P/8G/9C/10I/38Y/70W/82Q/180L/200A/214W, 6P/9C/10I/11T/36N/70W/82Q/180L/200A/214W/229M, 6P/9C/10I/38Y/70W/82Q/180L/186F/200A/214W/229M, 6P/9C/10I/70W/82Q/180L/186F/200A/214W/229M, 8A/9C/10I, 8G/9C/10I/11T/13E/70W, 8G/9C/10I/11T/13E/70W/82Q, 8G/9C/10I/11T/13E/70W/82Q/107F/229M, 8G/9C/10I/11T/36N/38Y/70W/82Q/180L/200A/214W, 8G/9C/10I/11T/38Y/70W/82Q/180L/200A/214W/229M, 8G/9C/10I/11T/431/70W/82Q/180L/200A/214W, 8G/9C/10I/11T/70W, 8G/9C/10I/11T/70W/82Q/107F/229M, 8G/9C/10I/11T/70W/229M, 8G/9C/10I/70W, 8G/9C/10I/70W/82Q/229M, 9A/10I/70W/82Q/180L/200A/214W, 9C/10I, 9C/10I/11E/12P/51D/70W/73M/110M/148L/180L, 9C/10I/11E/17C/70W/82Q/148L/180L/219H, 9C/10I/11E/17H/51D/54S/70W/82Q/180L, 9C/10I/11E/17H/70W/73M/82Q/87P/180L/219H, 9C/10I/11E/17V/49S/70W/82Q/180L/200H, 9C/10I/11E/49S/51D/54S/70W/82A/110M/148L/180L, 9C/10I/11E/49S/51D/54S/70W/82Q/87P/108H/110M/148L/180L/219H, 9C/10I/11E/49S/51D/54S/70W/82Q/87P/108H/180L, 9C/10I/11E/49S/51D/70W/82Q/108H/110M/148L/180L, 9C/10I/11E/49S/54S/70W/82Q/87P/148L/180L, 9C/10I/11E/49S/70W/82Q/87P/108H/110M/180L/200H, 9C/10I/11E/49S/70W/82Q/87P/180L, 9C/10I/11E/49S/70W/82Q/110M/148L/180L/225S, 9C/10I/11E/51D/54S/70W/82Q/148L/180L, 9C/10I/11E/54S/70W/82Q/87P/180L/192M, 9C/10I/11E/54S/70W/82Q/148L/180L/200H, 9C/10I/11E/70W/73L/82Q/108H/148L/180L, 9C/10I/11E/70W/73L/82Q/148L/180L, 9C/10I/11E/70W/73M/82Q/87P/110M/180L, 9C/10I/11E/70W/73M/82Q/148L/180L, 9C/10I/11E/70W/73M/82Q/148L/180L/192M/200H, 9C/10I/11E/70W/82Q/87P/110M/180L/219H, 9C/10I/11E/70W/82Q/148L/180L, 9C/10I/11E/70W/82Q/180L, 9C/10I/11E/70W/82Q/180L/200A/214W, 9C/10I/11G/17C/49S/70W/82Q/180L/219H, 9C/10I/11G/17V/51D/54S/70W/82Q/148L/180L/200H, 9C/10I/11G/51D/54S/70W/73L/82Q/108H/110M/180L, 9C/10I/11G/51D/70W/82Q/110M/180L/192M/219H, 9C/10I/11G/54S/70W/82Q/87P/108H/180L, 9C/10I/11G/70W/82Q/180L/200A/214W, 9C/10I/11I/35G/70W/82Q/180L/200A/214W, 9C/10I/11I/35Q/70W/82Q/180L/200A/214W, 9C/10I/11I/35S/70W/82Q/180L/200A/214W, 9C/10I/11I/361/70W/82Q/180L/200A/214W, 9C/10I/11I/36N/38Y/65I/70W/82Q/180L/200A/214W/229M, 9C/10I/11I/36N/38Y/70W/

82Q/180L/200A/214W, 9C/10I/11I/36N/38Y/70W/82Q/180L/200A/214W/229M, 9C/10I/11I/36N/70W/82Q/180L/196E/214W, 9C/10I/11I/36S/70W/82Q/180L/200A/214W, 9C/10I/11I/40V/70W/82Q/180L/200A/214W, 9C/10I/11I/54D/70W/82Q/180L/200A/214W, 9C/10I/11I/54P/70W/82Q/180L/200A/214W, 9C/10I/11I/54S/70W/82Q/180L/200A/214W, 9C/10I/11I/70V/82Q/180L/200A/214W, 9C/10I/11I/70W, 9C/10I/11I/70W/71H/82Q/180L/200A/214W, 9C/10I/11I/70W/71R/82Q/180L/200A/214W, 9C/10I/11I/70W/73L/82Q/180L/200A/214W, 9C/10I/11I/70W/73M/82Q/180L/200A/214W, 9C/10I/11I/70W/73R/82Q/180L/200A/214W, 9C/10I/11I/70W/82A/180L/200A/214W, 9C/10I/11I/70W/82Q/100S/180L/200A/214W, 9C/10I/11I/70W/82Q/108R/180L/200A/214W, 9C/10I/11I/70W/82Q/148L/180L/200A/214W, 9C/10I/11I/70W/82Q/180L/200A/214W, 9C/10I/11I/70W/87V/180L/200A/214W, 9C/10I/11T/36N/38Y/70W/82Q/180L/200A/214W/229M, 9C/10I/11T/36N/70W/82Q/180L/200A/214W/229M, 9C/10I/11T/38Y/70W/82Q/180L/186F/200A/214W, 9C/10I/11T/70W, 9C/10I/11T/70W/82Q, 9C/10I/11T/70W/82Q/107F, 9C/10I/11T/70W/107F, 9C/10I/12P/49S/51D/54S/70W/82Q/108H/148L/180L/225S, 9C/10I/12P/51D/70W/73L/82Q/148L/180L/200H, 9C/10I/12P/70W/82Q/180L/200A/214W, 9C/10I/12V/70W/82Q/180L/200A/214W, 9C/10I/13E/70W, 9C/10I/13E/70W/82Q, 9C/10I/13E/70W/229M, 9C/10I/13E/207Q, 9C/10I/17A/70W/82Q/180L/200A/214W, 9C/10I/17C/51D/54S/70W/82Q/87P/108H/110M/180L/200H, 9C/10I/17C/70W/73L/82Q/108H/110M/148L/180L/200H, 9C/10I/17C/70W/82Q/87P/148L/180L/192M/219H, 9C/10I/17C/70W/82Q/180L/200A/214W, 9C/10I/17H/49S/51D/54S/70W/73M/82Q/108H/110M/148L/180L/192M/200H/219H, 9C/10I/17H/54S/70W/82Q/87P/108H/110M/180L, 9C/10I/17H/70W/82Q/110M/148L/180L, 9C/10I/17H/70W/82Q/180L/200A/214W, 9C/10I/17Q/70W/82Q/180L/200A/214W, 9C/10I/17S/70W/82Q/180L/200A/214W, 9C/10I/17V/49S/51D/54S/70W/82Q/87P/180L/219H, 9C/10I/17V/49S/70W/82Q/148L/180L, 9C/10I/17V/51D/70W/73M/82Q/87P/108H/110M/148L/180L/219H, 9C/10I/17V/54S/70W/73L/82Q/87P/108H/110M/148L/180L/200H, 9C/10I/17V/54S/70W/73L/82Q/108H/110M/148L/180L, 9C/10I/17V/70W/73M/82Q/87P/180L/219H, 9C/10I/17V/70W/82Q/87P/148L/180L, 9C/10I/17V/70W/82Q/108H/148L/180L, 9C/10I/17V/70W/82Q/110M/148L/180L/200H, 9C/10I/17V/70W/82Q/180L/200A/214W, 9C/10I/17V/70W/104M/160E/165Q, 9C/10I/17V/70W/139H/160G/165Q, 9C/10I/17W, 9C/10I/26G, 9C/10I/26T, 9C/10I/29G/70W, 9C/10I/36N/70W/82Q/180L/200A/214W, 9C/10I/37P, 9C/10I/38Y/70W/82Q/180L/200A/214W, 9C/10I/39A/186T, 9C/10I/39W, 9C/10I/41F, 9C/10I/41G, 9C/10I/41S, 9C/10I/45R/70W, 9C/10I/45T/70W, 9C/10I/49S/51D/54S/70W/73M/82Q/148L/180L, 9C/10I/49S/51D/54S/70W/82G/108H/110M/148L/180L/225S, 9C/10I/49S/51D/54S/70W/82Q/110M/148L/180L, 9C/10I/49S/51D/54S/70W/82Q/110M/180L, 9C/10I/49S/51D/54S/70W/82Q/148L/180L, 9C/10I/49S/51D/54S/70W/82Q/148L/180L/192M, 9C/10I/49S/51D/70W/82Q/108H/148L/180L/219H, 9C/10I/49S/51D/70W/82Q/110M/148L/180L, 9C/10I/49S/51D/70W/82Q/180L/225S, 9C/10I/49S/54S/70W/73L/82Q/87P/110M/180L, 9C/10I/49S/54S/70W/82Q/87P/110M/180L, 9C/10I/49S/54S/70W/82Q/108H/148L/180L/225S, 9C/10I/49S/70W/73L/82G/108H/110M/148L/180L/225S, 9C/10I/49S/70W/73L/82Q/87P/108H/148L/180L, 9C/10I/49S/70W/82Q/87P/148L/180L, 9C/10I/49S/70W/82Q/110M/180L/219H, 9C/10I/51D/54S/70W/73L/82Q/108H/180L, 9C/10I/51D/54S/70W/73L/82Q/110M/148L/180L, 9C/10I/51D/54S/70W/73M/82Q/110M/180L, 9C/10I/51D/54S/70W/73M/82Q/180L/219H, 9C/10I/51D/54S/70W/73M/82Q/180L/225S, 9C/10I/51D/54S/70W/82Q/87P/180L, 9C/10I/51D/54S/70W/82Q/148L/180L, 9C/10I/51D/54S/70W/82Q/180L, 9C/10I/51D/54S/70W/82Q/180L/200H, 9C/10I/51D/70W/82Q/108H/180L, 9C/10I/51D/70W/82Q/110M/180L/200H, 9C/10I/51D/70W/82Q/180L/219H, 9C/10I/54S/70W/73M/82Q/108H/148L/180L/192M, 9C/10I/54S/70W/82G/180L, 9C/10I/54S/70W/82Q/87P/108H/180L/200H, 9C/10I/54S/70W/82Q/180L, 9C/10I/62G, 9C/10I/70R, 9C/10I/70W, 9C/10I/70W/73L/82Q/87P/108H/110M/180L, 9C/10I/70W/73L/82Q/108H/148L/180L, 9C/10I/70W/73L/82Q/108H/148L/180L/192M, 9C/10I/70W/73L/82Q/108H/180L, 9C/10I/70W/73L/82Q/148L/180L/200H, 9C/10I/70W/73L/82Q/180L/192M, 9C/10I/70W/73L/82Q/180L/192M/219H, 9C/10I/70W/73M/82Q/87P/180L/192M/219H, 9C/10I/70W/73M/82Q/87P/180L/200H, 9C/10I/70W/73M/82Q/108H/110M/180L/200H/219H, 9C/10I/70W/73M/82Q/108H/148L/180L, 9C/10I/70W/73M/82Q/108H/148L/180L/192M/219H, 9C/10I/70W/73M/82Q/148L/180L, 9C/10I/70W/82Q, 9C/10I/70W/82Q/87P/108H/110M/148L/180L/192M/219H, 9C/10I/70W/82Q/87P/108H/110M/180L, 9C/10I/70W/82Q/87P/108H/110M/180L/192M, 9C/10I/70W/82Q/87P/180L, 9C/10I/70W/82Q/107F, 9C/10I/70W/82Q/107F/229M, 9C/10I/70W/82Q/108H/110M/180L/219H, 9C/10I/70W/82Q/108H/180L, 9C/10I/70W/82Q/110M/148L/180L, 9C/10I/70W/82Q/110M/180L/219H, 9C/10I/70W/82Q/148L/180L, 9C/10I/70W/82Q/148L/180L/200H, 9C/10I/70W/82Q/148L/180L/200H/219H, 9C/10I/70W/82Q/180L, 9C/10I/70W/82Q/180L/192M/219H, 9C/10I/70W/82Q/180L/200A/214W, 9C/10I/70W/82Q/229M, 9C/10I/70W/92R, 9C/10I/70W/99R, 9C/10I/70W/99R/229M, 9C/10I/70W/107F/229M, 9C/10I/70W/156E, 9C/10I/70W/165Q, 9C/10I/70W/229M, 9C/10I/88G, 9C/10I/90S, 9C/10I/96F, 9C/10I/107F, 9C/10I/110V, 9C/10I/111M, 9C/10I/112G, 9C/10I/133E, 9C/10I/133W, 9C/10I/178E, 9C/10I/185E, 9C/10I/186Q, 9C/10I/196Q, 9C/10I/196R, 9C/10I/196S, 9C/10I/211E, 9C/10I/226E, 9C/10I/226W, 9R/10I/11E/12P/51D/54S/70W/73L/82Q/110M/180L, 9R/10I/11E/12P/51D/70W/73M/82Q/148L/180L/200H/225S, 9R/10I/11E/12S/51D/54S/70W/73M/82Q/148L/180L/225S, 9R/10I/54S/70W/82Q/180L, 9R/10I/70W/82Q/180L/200A/214W, 9T/10I/11E/12N/49S/70W/73M/82Q/180L, 9T/10/11E/12P/51D/70W/73L/82Q/148L/180L, 9T/10I/11G/12S/49S/51D/70W/73M/82Q/180L/200H/225S, 9T/10I/11G/51D/54S/70W/73L/82Q/108H/180L/200H/225S, 9T/10I/11G/51D/54S/70W/73L/82Q/110M/148L/180L, 9T/10I/11R/12P/51D/54S/70W/73L/82Q/108H/148L/180L/225S, 9T/10I/12P/70W/82A/148L/180L/225S, 9T/10I/12S/51D/54S/70W/180L/225S, 9T/10I/49S/51D/54S/70W/73M/82Q/108H/110M/148L/180L/192M, 9T/10I/70W/73L/82Q/108H/110M/148L/180L, 11L/24T, 11L/24T/219D, and 11L/36S/206F/208A, wherein the amino acid positions of the polypeptide sequence are numbered with reference to SEQ ID NO: 2. In some further embodiments, at least one substitution or substitution set in the polypeptide sequence comprises substitutions selected from: S3R/P4R/T6P/W9C/M10I/M11I/D36N/S38Y/N70W/V82Q/P180L/T200A/V214W/T229M, S3R/T6P/W9C/M10I/N70W/V99R, S3R/R8G/W9C/M10I/M11T/D13E/N70W/V82Q/A107F/T229M, S3R/R8G/W9C/M10I/M11T/D13E/N70W/A107F, S3R/R8G/W9C/M10I/M11T/N70W, S3R/R8G/W9C/M10I/M11T/N70W/T229M, S3R/R8G/W9C/M10I/D13E/N70W/V82Q/A107F, S3R/R8G/W9C/M10I/D13E/N70W/V82Q/T229M, S3R/R8G/W9C/M10I/N70W/V82Q, S3R/R8G/W9C/M10I/N70W/V82Q/T229M, S3R/R8G/W9C/M10I/N70W/T229M, S3R/W9C/M10I/M11I/D13E/V82Q, S3R/

W9C/M10I/M11T/N70W/V82Q/A107F, S3R/W9C/M10I/M11T/N70W/T229M, S3R/W9C/M10I/N70W/V82Q, S3R/W9C/M11I, S3R/W9C/M11I/N70W/V82Q/P180L, P4R/T6P/R8G/W9C/M10I/M11T/S38Y/N70W/V82Q/P180L/A186F/T200A/V214W/T229M, P4R/T6P/W9C/M10I/M11I/D36N/N70W/V82Q/P180L/T200A/V214W/T229M, P4R/T6P/W9C/M10I/M11I/S38Y/N70W/V82Q/P180L/A186F/T200A/V214W, P4R/T6P/W9C/M10I/N70W/V82Q/T229M, P4R/R8G/W9C/M10I/M11T/D13E/N70W/V82Q/A107F/T229M, P4R/R8G/W9C/M10I/M11T/D36N/S38Y/N70W/V82Q/P180L/T200A/V214W/T229M, P4R/R8G/W9C/M10I/M11T/D36N/N70W/V82Q/P180L/A186F/T200A/V214W/T229M, P4R/R8G/W9C/M10I/M11T/N70W/V82Q/P180L/T200A/V214W/T229M, P4R/R8G/W9C/M10I/D36N/S38Y/N70W/V82Q/P180L/T200A/V214W/T229M, P4R/W9C/M10I/M11I/D36N/S38Y/N70W/V82Q/P180L/T200A/V214W/T229M, P4R/W9C/M10I/M11T/D36N/R65I/N70W/V82Q/P180L/A186F/T200A/V214W, P4R/W9C/M10I/M11T/D36N/N70W/V82Q/P180L/T200A/V214W, P4R/W9C/M10I/M11T/D36N/N70W/V82Q/P180L/T200A/V214W/T229M, P4R/W9C/M10I/M11T/N70W/V82Q/P180L/T200A/V214W, T6P/R8G/W9C/M10I/S38Y/N70W/V82Q/P180L/T200A/V214W, T6P/W9C/M10I/M11T/D36N/N70W/V82Q/P180L/T200A/V214W/T229M, T6P/W9C/M10I/S38Y/N70W/V82Q/P180L/A186F/T200A/V214W/T229M, T6P/W9C/M10I/N70W/V82Q/P180L/A186F/T200A/V214W/T229M, R8A/W9C/M10I, R8G/W9C/M10I/M11T/D13E/N70W, R8G/W9C/M10I/M11T/D13E/N70W/V82Q, R8G/W9C/M10I/M11T/D13E/N70W/V82Q/A107F/T229M, R8G/W9C/M10I/M11T/D36N/S38Y/N70W/V82Q/P180L/T200A/V214W, R8G/W9C/M10I/M11T/S38Y/N70W/V82Q/P180L/T200A/V214W/T229M, R8G/W9C/M10I/M11T/M43I/N70W/V82Q/P180L/T200A/V214W, R8G/W9C/M10I/M11T/N70W, R8G/W9C/M10I/M11T/N70W/V82Q/A107F/T229M, R8G/W9C/M10I/M11T/N70W/T229M, R8G/W9C/M10I/N70W, R8G/W9C/M10I/N70W/V82Q/T229M, W9A/M10I/N70W/V82Q/P180L/T200A/V214W, W9C/M10I, W9C/M10I/M11E/L12P/Q51D/N70W/V73M/Q110M/M148L/P180L, W9C/M10I/M11E/R17C/N70W/V82Q/M148L/P180L/A219H, W9C/M10I/M11E/R17H/Q51D/A54S/N70W/V82Q/P180L, W9C/M10I/M11E/R17H/N70W/V73M/V82Q/A87P/P180L/A219H, W9C/M10I/M11E/R17V/R49S/N70W/V82Q/P180L/T200H, W9C/M10I/M11E/R49S/Q51D/A54S/N70W/V82A/Q10M/M148L/P180L, W9C/M10I/M11E/R49S/Q51D/A54S/N70W/V82Q/A87P/N108H/Q10M/M148L/P180L/A219H, W9C/M10I/M11E/R49S/Q51D/A54S/N70W/V82Q/A87P/N108H/P180L, W9C/M010/M11E/R49S/Q51D/N70W/V82Q/N108H/Q110M/M148L/P180L, W9C/M10I/M11E/R49S/A54S/N70W/V82Q/A87P/M148L/P180L, W9C/M10I/M11E/R49S/N70W/V82Q/A87P/N108H/Q10M/P180L/T200H, W9C/M10I/M11E/R49S/N70W/V82Q/A87P/P180L, W9C/M10I/M11E/R49S/N70W/V82Q/Q10M/M148L/P180L/Q225S, W9C/M10I/M11E/Q51D/A54S/N70W/V82Q/M148L/P180L, W9C/M10I/M11E/A54S/N70W/V82Q/A87P/P180L/Q192M, W9C/M10I/M11E/A54S/N70W/V82Q/M148L/P180L/T200H, W9C/M10I/M11E/N70W/V73L/V82Q/N108H/M148L/P180L, W9C/M10I/M11E/N70W/V73L/V82Q/M148L/P180L, W9C/M10I/M11E/N70W/V73M/V82Q/A87P/Q110M/P180L, W9C/M10I/M11E/N70W/V73M/V82Q/M148L/P180L, W9C/M10I/M11E/N70W/V73M/V82Q/M148L/P180L/Q192M/T200H, W9C/M10I/M11E/N70W/V82Q/A87P/Q10M/P180L/A219H, W9C/M10I/M11E/N70W/V82Q/M148L/P180L, W9C/M10I/M11E/N70W/V82Q/P180L, W9C/M10I/M11E/N70W/V82Q/P180L/T200A/V214W, W9C/M10I/M11G/R17C/R49S/N70W/V82Q/P180L/A219H, W9C/M10I/M11G/R17V/Q51D/A54S/N70W/V82Q/M148L/P180L/T200H, W9C/M10I/M11G/Q51D/A54S/N70W/V73L/V82Q/N108H/Q110M/P180L, W9C/M10I/M11G/Q51D/N70W/V82Q/Q110M/P180L/Q192M/A219H, W9C/M10I/M11G/A54S/N70W/V82Q/A87P/N108H/P180L, W9C/M10I/M11G/N70W/V82Q/P180L/T200A/V214W, W9C/M10I/M11I/A35G/N70W/V82Q/P180L/T200A/V214W, W9C/M10I/M11I/A35Q/N70W/V82Q/P180L/T200A/V214W, W9C/M10I/M11I/A35S/N70W/V82Q/P180L/T200A/V214W, W9C/M10I/M11I/D36I/N70W/V82Q/P180L/T200A/V214W, W9C/M10I/M11I/D36N/S38Y/R65I/N70W/V82Q/P180L/T200A/V214W/T229M, W9C/M10I/M11I/D36N/S38Y/N70W/V82Q/P180L/T200A/V214W, W9C/M10I/M11I/D36N/S38Y/N70W/V82Q/P180L/T200A/V214W/T229M, W9C/M10I/M11I/D36N/N70W/V82Q/P180L/A196E/V214W, W9C/M10I/M11I/D36S/N70W/V82Q/P180L/T200A/V214W, W9C/M10I/M11I/F40V/N70W/V82Q/P180L/T200A/V214W, W9C/M10I/M11I/A54D/N70W/V82Q/P180L/T200A/V214W, W9C/M10I/M11I/A54P/N70W/V82Q/P180L/T200A/V214W, W9C/M10I/M11I/A54S/N70W/V82Q/P180L/T200A/V214W, W9C/M10I/M11I/N70V/V82Q/P180L/T200A/V214W, W9C/M10I/M11I/N70W, W9C/M10I/M11I/N70W/N71H/V82Q/P180L/T200A/V214W, W9C/M10I/M11I/N70W/N71R/V82Q/P180L/T200A/V214W, W9C/M10I/M11I/N70W/V73L/V82Q/P180L/T200A/V214W, W9C/M10I/M11I/N70W/V73M/V82Q/P180L/T200A/V214W, W9C/M10I/M11I/N70W/V73R/V82Q/P180L/T200A/V214W, W9C/M10I/M11I/N70W/V82A/P180L/T200A/V214W, W9C/M10I/M11I/N70W/V82Q/A100S/P180L/T200A/V214W, W9C/M10I/M11I/N70W/V82Q/N108R/P180L/T200A/V214W, W9C/M10I/M11I/N70W/V82Q/M148L/P180L/T200A/V214W, W9C/M10I/M11I/N70W/V82Q/P180L/T200A/V214W, W9C/M10I/M11I/N70W/A87V/P180L/T200A/V214W, W9C/M10I/M11T/D36N/S38Y/N70W/V82Q/P180L/T200A/V214W/T229M, W9C/M10I/M11T/D36N/N70W/V82Q/P180L/T200A/V214W/T229M, W9C/M10I/M11T/S38Y/N70W/V82Q/P180L/A186F/T200A/V214W, W9C/M10I/M11T/N70W, W9C/M10I/M11T/N70W/V82Q, W9C/M10I/M11T/N70W/V82Q/A107F, W9C/M10I/M1 IT/N70W/A107F, W9C/M10I/L12P/R49S/Q51D/A54S/N70W/V82Q/N108H/M148L/P180L/Q225S, W9C/M10I/L12P/Q51D/N70W/V73L/V82Q/M148L/P180L/T200H, W9C/M10I/L12P/N70W/V82Q/P180L/T200A/V214W, W9C/M10I/L12V/N70W/V82Q/P180L/T200A/V214W, W9C/M10I/D13E/N70W, W9C/M10I/D13E/N70W/V82Q, W9C/M10I/D13E/N70W/T229M, W9C/M10I/D13E/P207Q, W9C/M10I/R17A/N70W/V82Q/P180L/T200A/V214W, W9C/M10I/R17C/Q51D/A54S/N70W/V82Q/A87P/N108H/Q110M/P180L/T200H, W9C/M10I/R17C/N70W/V73L/V82Q/N108H/Q110M/M148L/P180L/T200H, W9C/M10I/R17C/N70W/V82Q/A87P/M148L/P180L/Q192M/A219H, W9C/M10I/R17C/N70W/V82Q/P180L/T200A/V214W, W9C/M10I/R17H/R49S/Q51D/A54S/N70W/V73M/V82Q/N108H/Q110M/M148L/P180L/Q192M/T 200H/A219H, W9C/M10I/R17H/A54S/N70W/V82Q/A87P/N108H/Q110M/P180L, W9C/M10I/R17H/N70W/V82Q/Q110M/M148L/P180L, W9C/M10I/R17H/N70W/V82Q/P180L/T200A/V214W, W9C/M10I/R17Q/N70W/V82Q/P180L/T200A/V214W, W9C/M10I/R17S/N70W/V82Q/P180L/T200A/V214W, W9C/M10I/R17V/R49S/Q51D/A54S/N70W/V82Q/A87P/P180L/A219H, W9C/M10I/R17V/R49S/N70W/V82Q/M148L/P180L, W9C/M10I/R17V/Q51D/N70W/V73M/V82Q/

A87P/N108H/Q110M/M148L/P180L/A219H, W9C/M10I/R17V/A54S/N70W/V73L/V82Q/A87P/N108H/Q110M/M148L/P180L/T200H, W9C/M10I/R17V/A54S/N70W/V73L/V82Q/N108H/Q110M/M148L/P180L, W9C/M10I/R17V/N70W/V73M/V82Q/A87P/P180L/A219H, W9C/M10I/R17V/N70W/V82Q/A87P/M148L/P180L, W9C/M10I/R17V/N70W/V82Q/N108H/M148L/P180L, W9C/M10I/R17V/N70W/V82Q/Q110M/M148L/P180L/T200H, W9C/M10I/R17V/N70W/V82Q/P180L/T200A/V214W, W9C/M10I/R17V/N70W/A104M/S160E/G165Q, W9C/M10I/R17V/N70W/R139H/S160G/G165Q, W9C/M10I/R17W, W9C/M10I/A26G, W9C/M10I/A26T, W9C/M10I/W29G/N70W, W9C/M10I/D36N/N70W/V82Q/P180L/T200A/V214W, W9C/M10I/G37P, W9C/M10I/S38Y/N70W/V82Q/P180L/T200A/V214W, W9C/M10I/D39A/A186T, W9C/M10I/D39W, W9C/M10I/A41F, W9C/M10I/A41G, W9C/M10I/A41S, W9C/M10I/P45R/N70W, W9C/M10I/P45T/N70W, W9C/M10I/R49S/Q51D/A54S/N70W/V73M/V82Q/M148L/P180L, W9C/M10I/R49S/Q51D/A54S/N70W/V82G/N108H/Q110M/M148L/P180L/Q225S, W9C/M10I/R49S/Q51D/A54S/N70W/V82Q/Q110M/M148L/P180L, W9C/M10I/R49S/Q51D/A54S/N70W/V82Q/Q110M/P180L, W9C/M10I/R49S/Q51D/A54S/N70W/V82Q/M148L/P180L, W9C/M10I/R49S/Q51D/A54S/N70W/V82Q/M148L/P180L/Q192M, W9C/M10I/R49S/Q51D/N70W/V82Q/N108H/M148L/P180L/A219H, W9C/M10I/R49S/Q51D/N70W/V82Q/Q110M/M148L/P180L, W9C/M10I/R49S/Q51D/N70W/V82Q/P180L/Q225S, W9C/M10I/R49S/A54S/N70W/V73L/V82Q/A87P/Q110M/P180L, W9C/M10I/R49S/A54S/N70W/V82Q/A87P/Q110M/P180L, W9C/M10I/R49S/A54S/N70W/V82Q/N108H/M148L/P180L/Q225S, W9C/M10I/R49S/N70W/V73L/V82G/N108H/Q110M/M148L/P180L/Q225S, W9C/M10I/R49S/N70W/V73L/V82Q/A87P/N108H/M148L/P180L, W9C/M10I/R49S/N70W/V82Q/A87P/M148L/P180L, W9C/M10I/R49S/N70W/V82Q/Q110M/P180L/A219H, W9C/M10I/Q51D/A54S/N70W/V73L/V82Q/N108H/P180L, W9C/M10I/Q51D/A54S/N70W/V73L/V82Q/Q110M/M148L/P180L, W9C/M10I/Q51D/A54S/N70W/V73M/V82Q/Q110M/P180L, W9C/M10I/Q51D/A54S/N70W/V73M/V82Q/P180L/A219H, W9C/M10I/Q51D/A54S/N70W/V73M/V82Q/P180L/Q225S, W9C/M10I/Q51D/A54S/N70W/V82Q/A87P/P180L, W9C/M10I/Q51D/A54S/N70W/V82Q/M148L/P180L, W9C/M10I/Q51D/A54S/N70W/V82Q/P180L, W9C/M10I/Q51D/A54S/N70W/V82Q/P180L/T200H, W9C/M10I/Q51D/N70W/V82Q/N108H/P180L, W9C/M10I/Q51D/N70W/V82Q/Q110M/P180L/T200H, W9C/M10I/Q51D/N70W/V82Q/P180L/A219H, W9C/M10I/A54S/N70W/V73M/V82Q/N108H/M148L/P180L/Q192M, W9C/M10I/A54S/N70W/V82G/P180L, W9C/M10I/A54S/N70W/V82Q/A87P/N108H/P180L/T200H, W9C/M10I/A54S/N70W/V82Q/P180L, W9C/M10I/A62G, W9C/M10I/N70R, W9C/M10I/N70W, W9C/M10I/N70W/V73L/V82Q/A87P/N108H/Q110M/P180L, W9C/M10I/N70W/V73L/V82Q/N108H/M148L/P180L, W9C/M10I/N70W/V73L/V82Q/N108H/M148L/P180L/Q 192M, W9C/M10I/N70W/V73L/V82Q/N108H/P180L, W9C/M10I/N70W/V73L/V82Q/M148L/P180L/T200H, W9C/M10I/N70W/V73L/V82Q/P180L/Q192M, W9C/M10I/N70W/V73L/V82Q/P180L/Q192M/A219H, W9C/M10I/N70W/V73M/V82Q/A87P/P180L/Q192M/A219H, W9C/M10I/N70W/V73M/V82Q/A87P/P180L/T200H, W9C/M10I/N70W/V73M/V82Q/N108H/Q110M/P180L/T200H/A219H, W9C/M10I/N70W/V73M/V82Q/N108H/M148L/P180L, W9C/M10I/N70W/V73M/V82Q/N108H/M148L/P180L/Q192M/A219H, W9C/M10I/N70W/V73M/V82Q/M148L/P180L, W9C/M10I/N70W/V82Q, W9C/M10I/N70W/V82Q/A87P/N108H/Q110M/M148L/P180L/Q192M/A219H, W9C/M10I/N70W/V82Q/A87P/N108H/Q110M/P180L, W9C/M10I/N70W/V82Q/A87P/N108H/Q110M/P180L/Q192M, W9C/M10I/N70W/V82Q/A87P/P180L, W9C/M10I/N70W/V82Q/A107F, W9C/M10I/N70W/V82Q/A107F/T229M, W9C/M10I/N70W/V82Q/N108H/Q110M/P180L/A219H, W9C/M10I/N70W/V82Q/N108H/P180L, W9C/M10I/N70W/V82Q/Q110M/M148L/P180L, W9C/M10I/N70W/V82Q/Q110M/P180L/A219H, W9C/M10I/N70W/V82Q/M148L/P180L, W9C/M10I/N70W/V82Q/M148L/P180L/T200H, W9C/M10I/N70W/V82Q/M148L/P180L/T200H/A219H, W9C/M10I/N70W/V82Q/P180L, W9C/M10I/N70W/V82Q/P180L/Q192M/A219H, W9C/M10I/N70W/V82Q/P180L/T200A/V214W, W9C/M10I/N70W/V82Q/T229M, W9C/M10I/N70W/K92R, W9C/M10I/N70W/V99R, W9C/M10I/N70W/V99R/T229M, W9C/M10I/N70W/A107F/T229M, W9C/M10I/N70W/A156E, W9C/M10I/N70W/G165Q, W9C/M10I/N70W/T229M, W9C/M10I/Q88G, W9C/M10I/A90S, W9C/M10I/A96F, W9C/M10I/A107F, W9C/M10I/Q110V, W9C/M10I/A111M, W9C/M10I/R112G, W9C/M10I/A133E, W9C/M10I/A133W, W9C/M10I/A178E, W9C/M10I/R185E, W9C/M10I/A186Q, W9C/M10I/A196Q, W9C/M10I/A196R, W9C/M10I/A196S, W9C/M10I/Q211E, W9C/M10I/A226E, W9C/M10I/A226W, W9R/M10I/M11E/L12P/Q51D/A54S/N70W/V73L/V82Q/Q110M/P180L, W9R/M10I/M11E/L12P/Q51D/N70W/V73M/V82Q/M148L/P180L/T200H/Q225S, W9R/M10I/M11E/L12S/Q51D/A54S/N70W/V73M/V82Q/M148L/P180L/Q225S, W9R/M10I/A54S/N70W/V82Q/P180L, W9R/M10I/N70W/V82Q/P180L/T200A/V214W, W9T/M10I/M11E/L12N/R49S/N70W/V73M/V82Q/P180L, W9T/M10I/M11E/L12P/Q51D/N70W/V73L/V82Q/M148L/P180L, W9T/M10I/M11G/L12S/R49S/Q51D/N70W/V73M/V82Q/P180L/T200H/Q225S, W9T/M10I/M11G/Q51D/A54S/N70W/V73L/V82Q/N108H/P180L/T200H/Q225S, W9T/M10I/M11G/Q51D/A54S/N70W/V73L/V82Q/Q110M/M148L/P180L, W9T/M10I/M11R/L12P/Q51D/A54S/N70W/V73L/V82Q/N108H/M148L/P180L/Q225S, W9T/M10I/L12P/N70W/V82A/M148L/P180L/Q225S, W9T/M10I/L12S/Q51D/A54S/N70W/P180L/Q225S, W9T/M10I/R49S/Q51D/A54S/N70W/V73M/V82Q/N108H/Q110M/M148L/P180L/Q192M, W9T/M10I/N70W/V73L/V82Q/N108H/Q110M/M148L/P180L, M11L/Q24T, M11L/Q24T/A219D, and M11L/D36S/Y206F/M208A, wherein the amino acid positions of the polypeptide sequence are numbered with reference to SEQ ID NO: 2.

The present invention also provides engineered carboxyesterases comprising polypeptide sequences having at least 80%, 85%, 86%, 87%, 88%, 89%, 90%, 91%, 92%, 93%, 94%, 95%, 96%, 97%, 98%, 99%, or more sequence identity to SEQ ID NO: 82 or a functional fragment thereof, wherein the engineered carboxyesterases comprise at least one substitution or substitution set in their polypeptide sequences, and wherein the amino acid positions of the polypeptide sequences are numbered with reference to SEQ ID NO: 82.

The present invention also provides engineered carboxyesterases comprising polypeptide sequences having at least 80%, 85%, 86%, 87%, 88%, 89%, 90%, 91%, 92%, 93%, 94%, 95%, 96%, 97%, 98%, or 99%, sequence identity to SEQ ID NO: 268 or a functional fragment thereof, wherein the engineered carboxyesterases comprise at least one substitution or substitution set in the polypeptide sequences, and wherein the amino acid positions of the polypeptide sequences are numbered with reference to SEQ ID NO: 268.

The present invention also provides engineered carboxyesterases comprising polypeptide sequences having at least 80%, 85%, 86%, 87%, 88%, 89%, 90%, 91%, 92%, 93%, 94%, 95%, 96%, 97%, 98%, or 99%, sequence identity to SEQ ID NO: 536 or a functional fragment thereof, wherein the engineered carboxyesterases comprise at least one substitution or substitution set in the polypeptide sequences, and wherein the amino acid positions of the polypeptide sequences are numbered with reference to SEQ ID NO: 536.

The present invention also provides engineered carboxyesterases comprising polypeptide sequences having at least 80%, 85%, 86%, 87%, 88%, 89%, 90%, 91%, 92%, 93%, 94%, 95%, 96%, 97%, 98%, or 99%, sequence identity to a sequence selected from the even-numbered sequences of SEQ ID NOs: 2-536 or a functional fragment thereof, wherein the engineered carboxyesterases comprise at least one substitution or substitution set in the polypeptide sequences, and wherein the amino acid positions of the polypeptide sequences are numbered with reference to a sequence selected from the even-numbered sequences of SEQ ID NOs: 2-536.

The present invention also provides engineered carboxyesterases comprising polypeptide sequences selected from the even-numbered sequences of SEQ ID NOs: 4-536.

The present invention further provides engineered carboxyesterases exhibiting at least one improved property as compared to the wild-type *Xanthomonas campestris* carboxyesterase of SEQ ID NO: 2. In some embodiments, the improved property is selected from: improved hydrolysis activity, kinetic resolution, solvent tolerance, thermostability, pH stability, regiosteroselectivity, stereoselectivity, enantioselectivity, substrate scope, and/or reduced substrate or product inhibition, and reduced toxicity to bacterial host cells producing the engineered carboxyesterase.

The present invention further provides polynucleotide sequences encoding engineered carboxyesterases provided herein, wherein the polynucleotide sequence is operably linked to a control sequence. In some additional embodiments, the polynucleotide sequences are codon optimized.

The present invention also provides expression vectors comprising at least one polynucleotide sequence encoding an engineered carboxyesterase provided herein. In addition, the present invention provides host cells comprising at least one expression vector provided herein. In some embodiments, the present invention also provides host cells comprising at least one polynucleotide sequence encoding at least one engineered carboxyesterase provided herein.

The present invention also provides methods of producing an engineered carboxyesterase in a host cell, comprising culturing a host cell comprising an expression vector comprising at least one polynucleotide encoding at least one engineered carboxyesterase, under suitable conditions, such that at least one engineered carboxyesterase is produced. In some embodiments, the methods further comprise recovering at least one engineered carboxyesterase from the culture and/or host cell. In some additional embodiments, the methods further comprise the step of purifying the at least one engineered carboxyesterase.

DESCRIPTION OF THE INVENTION

The present invention provides engineered carboxyesterases (E.C. 3.1.1) having improved non-native properties as compared to naturally occurring wild-type (WT) carboxyesterase enzymes, as well as polynucleotides encoding the engineered carboxyesterase enzymes, host cells capable of expressing the engineered carboxyesterase enzymes, and methods of applying the engineered carboxyesterase enzymes to hydrolysis reactions.

Definitions

In reference to the present invention, the technical and scientific terms used in the descriptions herein will have the meanings commonly understood by one of ordinary skill in the art, unless specifically defined otherwise. Accordingly, the following terms are intended to have the following meanings. All U.S patents and published U.S. patent applications, including all sequences disclosed within such patents and patent applications, referred to herein are expressly incorporated by reference. Unless otherwise indicated, the practice of the present invention involves conventional techniques commonly used in molecular biology, fermentation, microbiology, and related fields, which are known to those of skill in the art. Unless defined otherwise herein, all technical and scientific terms used herein have the same meaning as commonly understood by one of ordinary skill in the art to which this invention belongs. Although any methods and materials similar or equivalent to those described herein can be used in the practice or testing of the present invention, the preferred methods and materials are described. Indeed, it is intended that the present invention not be limited to the particular methodology, protocols, and reagents described herein, as these may vary, depending upon the context in which they are used. The headings provided herein are not limitations of the various aspects or embodiments of the present invention.

Nonetheless, in order to facilitate understanding of the present invention, a number of terms are defined below. Numeric ranges are inclusive of the numbers defining the range. Thus, every numerical range disclosed herein is intended to encompass every narrower numerical range that falls within such broader numerical range, as if such narrower numerical ranges were all expressly written herein. It is also intended that every maximum (or minimum) numerical limitation disclosed herein includes every lower (or higher) numerical limitation, as if such lower (or higher) numerical limitations were expressly written herein.

As used herein, the term "comprising" and its cognates are used in their inclusive sense (i.e., equivalent to the term "including" and its corresponding cognates).

As used herein and in the appended claims, the singular "a", "an" and "the" include the plural reference unless the context clearly dictates otherwise. Thus, for example, reference to a "host cell" includes a plurality of such host cells.

Unless otherwise indicated, nucleic acids are written left to right in 5' to 3' orientation and amino acid sequences are written left to right in amino to carboxy orientation, respectively.

The headings provided herein are not limitations of the various aspects or embodiments of the invention that can be had by reference to the specification as a whole. Accordingly, the terms defined below are more fully defined by reference to the specification as a whole.

As used herein, "carboxyesterases" are defined as enzymes that naturally have catalytic activity toward the hydrolysis of carboxyesters which results in the formation of an organic acid and an alcohol.

As used herein, "amidation," or amide synthesis, refers to the process of generating an amide bond, resulting in a carboxamide (organic amide).

As used herein, the terms "protein," "polypeptide," and "peptide" are used interchangeably herein to denote a polymer of at least two amino acids covalently linked by an amide bond, regardless of length or post-translational modification (e.g., glycosylation, phosphorylation, lipidation, myristilation, ubiquitination, etc.). Included within this definition are D- and L-amino acids, and mixtures of D- and L-amino acids.

As used herein, "polynucleotide" and "nucleic acid' refer to two or more nucleosides that are covalently linked together. The polynucleotide may be wholly comprised ribonucleosides (i.e., an RNA), wholly comprised of 2' deoxyribonucleotides (i.e., a DNA) or mixtures of ribo- and 2' deoxyribonucleosides. While the nucleosides will typically be linked together via standard phosphodiester linkages, the polynucleotides may include one or more non-standard linkages. The polynucleotide may be single-stranded or double-stranded, or may include both single-stranded regions and double-stranded regions. Moreover, while a polynucleotide will typically be composed of the naturally occurring encoding nucleobases (i.e., adenine, guanine, uracil, thymine, and cytosine), it may include one or more modified and/or synthetic nucleobases (e.g., inosine, xanthine, hypoxanthine, etc.). In one embodiment of the invention, such modified or synthetic nucleobases will be encoding nucleobases.

As used herein, "coding sequence" refers to that portion of a nucleic acid (e.g., a gene) that encodes an amino acid sequence of a protein.

As used herein, "naturally occurring," "wild-type," and "WT" refer to the form found in nature. For example, a naturally occurring or wild-type polypeptide or polynucleotide sequence is a sequence present in an organism that can be isolated from a source in nature and which has not been intentionally modified by human manipulation.

As used herein, "non-naturally occurring" or "engineered" or "recombinant" when used in the present invention with reference to (e.g., a cell, nucleic acid, or polypeptide), refers to a material, or a material corresponding to the natural or native form of the material, that has been modified in a manner that would not otherwise exist in nature, or is identical thereto but produced or derived from synthetic materials and/or by manipulation using recombinant techniques. Non-limiting examples include, among others, recombinant cells expressing genes that are not found within the native (non-recombinant) form of the cell or express native genes that are otherwise expressed at a different level.

As used herein, "percentage of sequence identity," "percent identity," and "percent identical" refer to comparisons between polynucleotide sequences or polypeptide sequences, and are determined by comparing two optimally aligned sequences over a comparison window, wherein the portion of the polynucleotide or polypeptide sequence in the comparison window may comprise additions or deletions (i.e., gaps) as compared to the reference sequence for optimal alignment of the two sequences. The percentage is calculated by determining the number of positions at which either the identical nucleic acid base or amino acid residue occurs in both sequences or a nucleic acid base or amino acid residue is aligned with a gap to yield the number of matched positions, dividing the number of matched positions by the total number of positions in the window of comparison and multiplying the result by 100 to yield the percentage of sequence identity. Determination of optimal alignment and percent sequence identity is performed using the BLAST and BLAST 2.0 algorithms (See, e.g., Altschul et al., J. Mol. Biol. 215: 403-410 [1990]; and Altschul, et al., Nucleic Acids Res. 3389-3402 [1977]). Software for performing BLAST analyses is publicly available through the National Center for Biotechnology Information website.

Briefly, the BLAST analyses involve first identifying high scoring sequence pairs (HSPs) by identifying short words of length within the query sequence, which either match or satisfy some positive-valued threshold score T when aligned with a word of the same length in a database sequence. T is referred to as, the neighborhood word score threshold (Altschul, et al., supra). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, M=5, N=−4, and a comparison of both strands. For amino acid sequences, the BLASTP program uses as defaults a wordlength (W) of 3, an expectation (E) of 10, and the BLOSUM62 scoring matrix (See, e.g., Henikoff and Henikoff, Proc Natl Acad Sci USA 89:10915 [1989]).

Numerous other algorithms are available and known in the art that function similarly to BLAST in providing percent identity for two sequences. Optimal alignment of sequences for comparison can be conducted using any suitable method known in the art (e.g., by the local homology algorithm of Smith and Waterman, Adv. Appl. Math. 2:482 [1981]; by the homology alignment algorithm of Needleman and Wunsch, J. Mol. Biol. 48:443 [1970]; by the search for similarity method of Pearson and Lipman, Proc. Natl. Acad. Sci. USA 85:2444 [1988]; and/or by computerized implementations of these algorithms [GAP, BESTFIT, FASTA, and TFASTA in the GCG Wisconsin Software Package]), or by visual inspection, using methods commonly known in the art. Additionally, determination of sequence alignment and percent sequence identity can employ the BESTFIT or GAP programs in the GCG Wisconsin Software package (Accelrys, Madison WI), using the default parameters provided.

As used herein, "reference sequence" refers to a defined sequence to which another sequence is compared. A reference sequence may be a subset of a larger sequence, for example, a segment of a full-length gene or polypeptide sequence. Generally, a reference sequence is at least 20 nucleotide or amino acid residues in length, at least 25 residues in length, at least 50 residues in length, or the full length of the nucleic acid or polypeptide. Since two polynucleotides or polypeptides may each (1) comprise a sequence (i.e., a portion of the complete sequence) that is similar between the two sequences, and (2) may further comprise a sequence that is divergent between the two sequences, sequence comparisons between two (or more) polynucleotides or polypeptide are typically performed by comparing sequences of the two polynucleotides over a comparison window to identify and compare local regions of sequence similarity. The term "reference sequence" is not intended to be limited to wild-type sequences, and can include engineered or altered sequences. For example, in some embodiments, a "reference sequence" can be a previously engineered or altered amino acid sequence.

As used herein, "comparison window" refers to a conceptual segment of at least about 20 contiguous nucleotide positions or amino acids residues wherein a sequence may be compared to a reference sequence of at least 20 contiguous nucleotides or amino acids and wherein the portion of the sequence in the comparison window may comprise additions or deletions (i.e., gaps) of 20 percent or less as compared to the reference sequence (which does not comprise additions or deletions) for optimal alignment of the two sequences. The comparison window can be longer than 20 contiguous residues, and includes, optionally 30, 40, 50, 100, or longer windows.

As used herein, "corresponding to", "reference to" or "relative to" when used in the context of the numbering of a given amino acid or polynucleotide sequence refers to the numbering of the residues of a specified reference sequence when the given amino acid or polynucleotide sequence is compared to the reference sequence. In other words, the residue number or residue position of a given polymer is designated with respect to the reference sequence rather than by the actual numerical position of the residue within the given amino acid or polynucleotide sequence. For example, a given amino acid sequence, such as that of an engineered carboxyesterase, can be aligned to a reference sequence by introducing gaps to optimize residue matches between the two sequences. In these cases, although the gaps are present, the numbering of the residue in the given amino acid or polynucleotide sequence is made with respect to the reference sequence to which it has been aligned. As used herein, a reference to a residue position, such as "Xn" as further described below, is to be construed as referring to "a residue corresponding to", unless specifically denoted otherwise. Thus, for example, "X94" refers to any amino acid at position 94 in a polypeptide sequence (e.g., SEQ ID NOS:2, 4, 10, 26, or 42).

As used herein, "stereoselectivity" refers to the preferential formation in a chemical or enzymatic reaction of one stereoisomer over another stereoisomer or another set of stereoisomers. Stereoselectivity can be partial, where the formation of a stereoisomer is favored over another, or it may be complete where only one stereoisomer is formed. When the stereoisomers are enantiomers, the stereoselectivity is referred to as enantioselectivity, the fraction (typically reported as a percentage) of one enantiomer in the sum of both enantiomers. It is commonly alternatively reported in the art (typically as a percentage) as the enantiomeric excess (e.e.) calculated therefrom according to the formula [major enantiomer−minor enantiomer]/[major enantiomer+minor enantiomer]. Where the stereoisomers are diastereoisomers, the stereoselectivity is referred to as diastereoselectivity, the fraction (typically reported as a percentage) of one diastereomer in a mixture of two diastereomers, commonly alternatively reported as the diastereomeric excess (d.e.). Enantiomeric excess and diastereomeric excess are types of stereomeric excess. It is also to be understood that stereoselectivity is not limited to single stereoisomers and can be described for sets of stereoisomers.

As used herein, "enantiospecifity" or "E value" refers to preferential conversion in a chemical or enzymatic reaction of one stereoisomer over another stereoisomer, whereas the ee refers to the enantiomeric purity of the compound. In a kinetic resolution, The E value is independent of the substrate and enzyme concentrations and can be determined from the % ee of substrate and the % ee of product by using the equation $\ln[(1-ee_s)/(1+ee_s/ee_p)]/\ln[(1+ee_s)/(1+ee_s/ee_p)]$, as described in Enzyme Microbio Technol, 1997, 21:559-571.

As used herein, "highly stereoselective" or "highly enantioselective" refers to a chemical or enzymatic reaction that is capable of converting a substrate to its corresponding chiral acid product, with at least about 75% stereomeric excess.

As used herein, "increased enzymatic activity" and "increased activity" refer to an improved property of an engineered enzyme, which can be represented by an increase in specific activity (e.g., product produced/time/weight protein) or an increase in percent conversion of the substrate to the product (e.g., percent conversion of starting amount of substrate to product in a specified time period using a specified amount of carboxyesterase) as compared to a reference enzyme. Exemplary methods to determine enzyme activity are provided in the Examples. Any property relating to enzyme activity may be affected, including the classical enzyme properties of Km, Vmax or kcat, changes of which can lead to increased enzymatic activity. The carboxyesterase activity can be measured by any one of standard assays used for measuring carboxyesterases, such as change in substrate or product concentration. Comparisons of enzyme activities are made using a defined preparation of enzyme, a defined assay under a set condition, and one or more defined substrates, as further described in detail herein. Generally, when enzymes in cell lysates are compared, the numbers of cells and the amount of protein assayed are determined as well as use of identical expression systems and identical host cells to minimize variations in amount of enzyme produced by the host cells and present in the lysates.

As used herein, "conversion" refers to the enzymatic transformation of a substrate to the corresponding product.

As used herein "percent conversion" refers to the percent of the substrate that is converted to the product within a period of time under specified conditions. Thus, for example, the "enzymatic activity" or "activity" of a carboxyesterase polypeptide can be expressed as "percent conversion" of the substrate to the product.

As used herein, "regiospecificity" refers to chemical reactions in which one structural isomer is produced exclusively when other isomers are also theoretically possible.

As used herein, "thermostable" or "thermal stable" are used interchangeably to refer to a polypeptide that is resistant to inactivation when exposed to a set of temperature conditions (e.g., 40-80° C.) for a period of time (e.g., 0.5-24 hrs) compared to the untreated enzyme, thus retaining a certain level of residual activity (e.g., more than 60% to 80% for example) after exposure to elevated temperatures.

As used herein, "solvent stable" refers to the ability of a polypeptide to maintain similar activity (e.g., more than e.g., 60% to 80%) after exposure to varying concentrations (e.g., 5-99%) of solvent (e.g., isopropyl alcohol, tetrahydrofuran, 2-methyltetrahydrofuran, acetone, toluene, butylacetate, methyl tert-butylether, etc.) for a period of time (e.g., 0.5-24 hrs) compared to the untreated enzyme.

As used herein, "amino acid difference" or "residue difference" refers to a difference in the amino acid residue at a position of a polypeptide sequence relative to the amino acid residue at a corresponding position in a reference sequence. The positions of amino acid differences generally are referred to herein as "Xn", where n refers to the corresponding position in the reference sequence upon which the residue difference is based. For example, a "residue difference at position X40 as compared to SEQ ID NO:2" refers to a difference of the amino acid residue at the polypeptide position corresponding to position 40 of SEQ ID NO:2. Thus, if the reference polypeptide of SEQ ID NO:2 has a histidine at position 40, then a "residue difference at position X40 as compared to SEQ ID NO:2" refers to an amino acid substitution of any residue other than histidine at the position of the polypeptide corresponding to position 40 of SEQ ID NO:2. In most instances herein, the specific amino acid residue difference at a position is indicated as "XnY" where "Xn" specified the corresponding position as described above, and "Y" is the single letter identifier of the amino acid found in the engineered polypeptide (i.e., the different residue than in the reference polypeptide). In some instances, the present invention also provides specific amino acid differences denoted by the conventional notation "AnB", where A is the single letter identifier of the residue in the reference sequence, "n" is the number of the residue position in the reference sequence, and B is the single letter identifier of the residue substitution in the sequence of the engineered polypeptide. In some instances, a polypeptide of the present invention can include at least one amino acid residue differences relative to a reference sequence, which is indicated by a list of the specified positions where residue differences are present relative to the reference sequence. In some embodiments, where more than one amino acid can be used in a specific residue position of a polypeptide, the various amino acid residues that can be used are separated by a "/" (e.g., X192A/G). The present invention includes engineered polypeptide sequences comprising at least one amino acid differences that include either/or both conservative and non-conservative amino acid substitutions. The amino acid sequences of the specific recombinant carbonic anhydrase polypeptides included in the Sequence Listing of the present invention include an initiating methionine (M) residue (i.e., M represents residue position 1). The skilled artisan, however, understands that this initiating methionine residue can be removed by biological processing machinery, such as in a host cell or in vitro translation system, to generate a mature protein lacking the initiating methionine residue, but otherwise retaining the enzyme's properties. Consequently, the term "amino acid residue difference relative to SEQ ID NO:2 at position Xn" as used herein may refer to position "Xn" or to the corresponding position (e.g., position (X−1)n) in a reference sequence that has been processed so as to lack the starting methionine.

As used herein, the phrase "conservative amino acid substitutions" refers to the interchangeability of residues having similar side chains, and thus typically involves substitution of the amino acid in the polypeptide with amino acids within the same or similar defined class of amino acids. By way of example and not limitation, in some embodiments, an amino acid with an aliphatic side chain is substituted with another aliphatic amino acid (e.g., alanine, valine, leucine, and isoleucine); an amino acid with a hydroxyl side chain is substituted with another amino acid with a hydroxyl side chain (e.g., serine and threonine); an amino acids having aromatic side chains is substituted with another amino acid having an aromatic side chain (e.g., phenylalanine, tyrosine, tryptophan, and histidine); an amino acid with a basic side chain is substituted with another amino acid with a basic side chain (e.g., lysine and arginine); an amino acid with an acidic side chain is substituted with another amino acid with an acidic side chain (e.g., aspartic acid or glutamic acid); and/or a hydrophobic or hydrophilic amino acid is replaced with another hydrophobic or hydrophilic amino acid, respectively. The appropriate classification of any amino acid or residue will be apparent to those of skill in the art, especially in light of the detailed invention provided herein. Exemplary conservative substitutions are provided in Table 1.

TABLE 1

Exemplary Conservative Amino Acid Substitutions

| Residue | Possible Conservative Substitutions |
|---|---|
| A, L, V, I | Other aliphatic (A, L, V, I)<br>Other non-polar (A, L, V, I, G, M) |
| G, M | Other non-polar (A, L, V, I, G, M) |
| D, E | Other acidic (D, E) |
| K, R | Other basic (K, R) |
| P | none |
| N, Q, S, T | Other polar |
| H, Y, W, F | Other aromatic (H, Y, W, F) |
| C | none |

As used herein, the phrase "non-conservative substitution" refers to substitution of an amino acid in the polypeptide with an amino acid with significantly differing side chain properties. Non-conservative substitutions may use amino acids between, rather than within, the defined groups and affects (a) the structure of the peptide backbone in the area of the substitution (e.g., proline for glycine) (b) the charge or hydrophobicity, or (c) the bulk of the side chain. By way of example and not limitation, an exemplary non-conservative substitution can be an acidic amino acid substituted with a basic or aliphatic amino acid; an aromatic amino acid substituted with a small amino acid; and a hydrophilic amino acid substituted with a hydrophobic amino acid.

As used herein, "deletion" refers to modification of the polypeptide by removal of one or more amino acids from the reference polypeptide. Deletions can comprise removal of 1 or more amino acids, 2 or more amino acids, 5 or more amino acids, 10 or more amino acids, 15 or more amino acids, or 20 or more amino acids, up to 10% of the total number of amino acids, or up to 20% of the total number of amino acids making up the polypeptide while retaining enzymatic activity and/or retaining the improved properties of an engineered enzyme. Deletions can be directed to the internal portions and/or terminal portions of the polypeptide. In various embodiments, the deletion can comprise a continuous segment or can be discontinuous.

As used herein, "insertion" refers to modification of the polypeptide by addition of one or more amino acids to the reference polypeptide. In some embodiments, the improved engineered carboxyesterase enzymes comprise insertions of one or more amino acids to the naturally occurring carboxyesterase polypeptide as well as insertions of one or more amino acids to engineered carboxyesterase polypeptides. Insertions can be in the internal portions of the polypeptide, or to the carboxy or amino terminus. Insertions as used herein include fusion proteins as is known in the art. The insertion can be a contiguous segment of amino acids or separated by one or more of the amino acids in the naturally occurring polypeptide.

The term "amino acid substitution set" or "substitution set" refers to a group of amino acid substitutions in a polypeptide sequence, as compared to a reference sequence. A substitution set can have 2, 3, 4, 5, 6, 7, 8, 9, 10, 11, 12, 13, 14, 15, or more amino acid substitutions. In some embodiments, a substitution set refers to the set of amino acid substitutions that is present in any of the variant carboxyesterases included in the Tables provided in the Examples.

As used herein, "fragment" refers to a polypeptide that has an amino-terminal and/or carboxy-terminal deletion, but where the remaining amino acid sequence is identical to the corresponding positions in the sequence. Fragments can typically have about 80%, about 90%, about 95%, about 98%, or about 99% of the full-length carboxyesterase polypeptide, for example, the polypeptide of SEQ ID NO:4. In some embodiments, the fragment is "biologically active" (i.e., it exhibits the same enzymatic activity as the full-length sequence).

A "functional fragment", or a "biologically active fragment", used interchangeably, herein refers to a polypeptide that has an amino-terminal and/or carboxy-terminal deletion(s) and/or internal deletions, but where the remaining amino acid sequence is identical to the corresponding positions in the sequence to which it is being compared (e.g., a full-length engineered *X. campestris* enzyme of the present invention) and that retains substantially all of the activity of the full-length polypeptide.

As used herein, "isolated polypeptide" refers to a polypeptide which is substantially separated from other contaminants that naturally accompany it (e.g., protein, lipids, and polynucleotides). The term embraces polypeptides which have been removed or purified from their naturally-occurring environment or expression system (e.g., host cell or in vitro synthesis). The improved carboxyesterase enzymes may be present within a cell, present in the cellular medium, or prepared in various forms, such as lysates or isolated preparations. As such, in some embodiments, the engineered carboxyesterase polypeptides of the present invention can be an isolated polypeptide.

As used herein, "substantially pure polypeptide" refers to a composition in which the polypeptide species is the predominant species present (i.e., on a molar or weight basis it is more abundant than any other individual macromolecular species in the composition), and is generally a substantially purified composition when the object species comprises at least about 50 percent of the macromolecular species present by mole or % weight. Generally, a substantially pure engineered carboxyesterase polypeptide composition will comprise about 60% or more, about 70% or more, about 80% or more, about 90% or more, about 91% or more, about 92% or more, about 93% or more, about 94% or more, about 95% or more, about 96% or more, about 97% or more, about 98% or more, or about 99% of all macromolecular species by mole or % weight present in the composition. Solvent species, small molecules (<500 Daltons), and elemental ion species are not considered macromolecular species. In some embodiments, the isolated improved carboxyesterase polypeptide is a substantially pure polypeptide composition.

As used herein, when used with reference to a nucleic acid or polypeptide, the term "heterologous" refers to a sequence that is not normally expressed and secreted by an organism (e.g., a wild-type organism). In some embodiments, the term encompasses a sequence that comprises two or more subsequences which are not found in the same relationship to each other as normally found in nature, or is recombinantly engineered so that its level of expression, or physical relationship to other nucleic acids or other molecules in a cell, or structure, is not normally found in nature. For instance, a heterologous nucleic acid is typically recombinantly produced, having two or more sequences from unrelated genes arranged in a manner not found in nature (e.g., a nucleic acid open reading frame (ORF) of the invention operatively linked to a promoter sequence inserted into an expression cassette, such as a vector). In some embodiments, "heterologous polynucleotide" refers to any polynucleotide that is introduced into a host cell by laboratory techniques, and includes polynucleotides that are removed from a host cell, subjected to laboratory manipulation, and then reintroduced into a host cell.

As used herein, "codon optimized" refers to changes in the codons of the polynucleotide encoding a protein to those preferentially used in a particular organism such that the encoded protein is efficiently expressed in the organism of interest. In some embodiments, the polynucleotides encoding the carboxyesterase enzymes may be codon optimized for optimal production from the host organism selected for expression.

As used herein, "control sequence" is defined herein to include all components, which are necessary or advantageous for the expression of a polynucleotide and/or polypeptide of the present invention. Each control sequence may be native or foreign to the polynucleotide of interest. Such control sequences include, but are not limited to, a leader, polyadenylation sequence, propeptide sequence, promoter, signal peptide sequence, and transcription terminator.

As used herein, "operably linked" is defined herein as a configuration in which a control sequence is appropriately placed (i.e., in a functional relationship) at a position relative to a polynucleotide of interest such that the control sequence directs or regulates the expression of the polynucleotide and/or polypeptide of interest.

As used herein, "suitable reaction conditions" refer to those conditions in the biocatalytic reaction solution (e.g., ranges of enzyme loading, substrate loading, temperature, pH, buffers, co-solvents, etc.) under which an carboxyesterase polypeptide of the present invention is capable of converting a substrate compound to a product compound (e.g., conversion of one compound to another compound). Exemplary "suitable reaction conditions" are provided in the present invention and illustrated by the Examples.

As used herein, "loading," such as in "compound loading," "enzyme loading," or "substrate loading" refers to the concentration or amount of a component in a reaction mixture at the start of the reaction.

As used herein, "substrate" in the context of a biocatalyst mediated process refers to the compound or molecule acted on by the biocatalyst.

As used herein "product" in the context of a biocatalyst mediated process refers to the compound or molecule resulting from the action of the biocatalyst.

As used herein, "equilibration" as used herein refers to the process resulting in a steady state concentration of chemical species in a chemical or enzymatic reaction (e.g., interconversion of two species A and B), including interconversion of stereoisomers, as determined by the forward rate constant and the reverse rate constant of the chemical or enzymatic reaction.

As used herein, "alkyl" refers to saturated hydrocarbon groups of from 1 to 18 carbon atoms inclusively, either straight chained or branched, more preferably from 1 to 8 carbon atoms inclusively, and most preferably 1 to 6 carbon atoms inclusively. An alkyl with a specified number of carbon atoms is denoted in parenthesis (e.g., (C1-C4) alkyl refers to an alkyl of 1 to 4 carbon atoms).

As used herein, "alkenyl" refers to groups of from 2 to 12 carbon atoms inclusively, either straight or branched containing at least one double bond but optionally containing more than one double bond.

As used herein, "alkynyl" refers to groups of from 2 to 12 carbon atoms inclusively, either straight or branched containing at least one triple bond but optionally containing more than one triple bond, and additionally optionally containing one or more double bonded moieties.

As used herein, "heteroalkyl, "heteroalkenyl," and heteroalkynyl," refer to alkyl, alkenyl and alkynyl as defined herein in which one or more of the carbon atoms are each independently replaced with the same or different heteroatoms or heteroatomic groups. Heteroatoms and/or heteroatomic groups which can replace the carbon atoms include, but are not limited to, —O—, —S—, —S—O—, —NRα—, —PH—, —S(O)—, —S(O)2-, —S(O) NRα-, —S(O) 2NRα-, and the like, including combinations thereof, where each Rα is independently selected from hydrogen, alkyl, heteroalkyl, cycloalkyl, heterocycloalkyl, aryl, and heteroaryl.

As used herein, "alkoxy" refers to the group —ORβ wherein R β is an alkyl group is as defined above including optionally substituted alkyl groups as also defined herein.

As used herein, "aryl" refers to an unsaturated aromatic carbocyclic group of from 6 to 12 carbon atoms inclusively having a single ring (e.g., phenyl) or multiple condensed rings (e.g., naphthyl or anthryl). Exemplary aryls include phenyl, pyridyl, naphthyl and the like.

As used herein, "amino" refers to the group —NH2. Substituted amino refers to the group —NHRδ, NRδRδ, and NRδRδRδ, where each Rδ is independently selected from substituted or unsubstituted alkyl, cycloalkyl, cycloheteroalkyl, alkoxy, aryl, heteroaryl, heteroarylalkyl, acyl, alkoxycarbonyl, sulfanyl, sulfinyl, sulfonyl, and the like. Typical amino groups include, but are limited to, dimethylamino, diethylamino, trimethylammonium, triethylammonium, methylysulfonylamino, furanyl-oxy-sulfamino, and the like.

As used herein, "oxo" refers to ═O.

As used herein, "oxy" refers to a divalent group —O—, which may have various substituents to form different oxy groups, including ethers and esters.

As used herein, "carboxy" refers to —COOH.

As used herein, "carbonyl" refers to —C(O)—, which may have a variety of substituents to form different carbonyl groups including acids, acid halides, aldehydes, amides, esters, and ketones.

As used herein, "alkyloxycarbonyl" refers to —C(O)ORε, where Rε is an alkyl group as defined herein, which can be optionally substituted.

As used herein, "aminocarbonyl" refers to —C(O)NH2. Substituted aminocarbonyl refers to —C(O)NRδRδ, where the amino group NRδRδ is as defined herein.

As used herein, "halogen" and "halo" refer to fluoro, chloro, bromo and iodo.

As used herein, "hydroxy" refers to —OH.

As used herein, "cyano" refers to —CN.

As used herein, "heteroaryl" refers to an aromatic heterocyclic group of from 1 to 10 carbon atoms inclusively and 1 to 4 heteroatoms inclusively selected from oxygen, nitrogen and sulfur within the ring. Such heteroaryl groups can have a single ring (e.g., pyridyl or furyl) or multiple condensed rings (e.g., indolizinyl or benzothienyl).

As used herein, "heteroarylalkyl" refers to an alkyl substituted with a heteroaryl (i.e., heteroaryl-alkyl- groups), preferably having from 1 to 6 carbon atoms inclusively in the alkyl moiety and from 5 to 12 ring atoms inclusively in the heteroaryl moiety. Such heteroarylalkyl groups are exemplified by pyridylmethyl and the like.

As used herein, "heteroarylalkenyl" refers to an alkenyl substituted with a heteroaryl (i.e., heteroaryl-alkenyl- groups), preferably having from 2 to 6 carbon atoms inclusively in the alkenyl moiety and from 5 to 12 ring atoms inclusively in the heteroaryl moiety.

As used herein, "heteroarylalkynyl" refers to an alkynyl substituted with a heteroaryl (i.e., heteroaryl-alkynyl- groups), preferably having from 2 to 6 carbon atoms inclusively in the alkynyl moiety and from 5 to 12 ring atoms inclusively in the heteroaryl moiety.

As used herein, "heterocycle," "heterocyclic," and interchangeably "heterocycloalkyl," refer to a saturated or unsaturated group having a single ring or multiple condensed rings, from 2 to 10 carbon ring atoms inclusively and from 1 to 4 hetero ring atoms inclusively selected from nitrogen, sulfur or oxygen within the ring. Such heterocyclic groups can have a single ring (e.g., piperidinyl or tetrahydrofuryl) or multiple condensed rings (e.g., indolinyl, dihydrobenzofuran or quinuclidinyl). Examples of heterocycles include, but are not limited to, furan, thiophene, thiazole, oxazole, pyrrole, imidazole, pyrazole, pyridine, pyrazine, pyrimidine, pyridazine, indolizine, isoindole, indole, indazole, purine, quinolizine, isoquinoline, quinoline, phthalazine, naphthylpyridine, quinoxaline, quinazoline, cinnoline, pteridine, carbazole, carboline, phenanthridine, acridine, phenanthroline, isothiazole, phenazine, isoxazole, phenoxazine, phenothiazine, imidazolidine, imidazoline, piperidine, piperazine, pyrrolidine, indoline and the like.

As used herein, "membered ring" is meant to embrace any cyclic structure. The number preceding the term "membered" denotes the number of skeletal atoms that constitute the ring. Thus, for example, cyclohexyl, pyridine, pyran and thiopyran are 6-membered rings and cyclopentyl, pyrrole, furan, and thiophene are 5-membered rings.

Unless otherwise specified, positions occupied by hydrogen in the foregoing groups can be further substituted with substituents exemplified by, but not limited to, hydroxy, oxo, nitro, methoxy, ethoxy, alkoxy, substituted alkoxy, trifluoromethoxy, haloalkoxy, fluoro, chloro, bromo, iodo, halo, methyl, ethyl, propyl, butyl, alkyl, alkenyl, alkynyl, substituted alkyl, trifluoromethyl, haloalkyl, hydroxyalkyl, alkoxyalkyl, thio, alkylthio, acyl, carboxy, alkoxycarbonyl, carboxamido, substituted carboxamido, alkylsulfonyl, alkylsulfinyl, alkylsulfonylamino, sulfonamido, substituted sulfonamido, cyano, amino, substituted amino, alkylamino, dialkylamino, aminoalkyl, acylamino, amidino, amidoximo, hydroxamoyl, phenyl, aryl, substituted aryl, aryloxy, arylalkyl, arylalkenyl, arylalkynyl, pyridyl, imidazolyl, heteroaryl, substituted heteroaryl, heteroaryloxy, heteroarylalkyl, heteroarylalkenyl, heteroarylalkynyl, cyclopropyl, cyclobutyl, cyclopentyl, cyclohexyl, cycloalkyl, cycloalkenyl, cycloalkylalkyl, substituted cycloalkyl, cycloalkyloxy, pyrrolidinyl, piperidinyl, morpholino, heterocycle, (heterocycle)oxy, and (heterocycle)alkyl; and preferred heteroatoms are oxygen, nitrogen, and sulfur. It is understood that where open valences exist on these substituents they can be further substituted with alkyl, cycloalkyl, aryl, heteroaryl, and/or heterocycle groups, that where these open valences exist on carbon they can be further substituted by halogen and by oxygen-, nitrogen-, or sulfur-bonded substituents, and where multiple such open valences exist, these groups can be joined to form a ring, either by direct formation of a bond or by formation of bonds to a new heteroatom, preferably oxygen, nitrogen, or sulfur. It is further understood that the above substitutions can be made provided that replacing the hydrogen with the substituent does not introduce unacceptable instability to the molecules of the present invention, and is otherwise chemically reasonable.

As used herein, “optional” and “optionally” means that the subsequently described event or circumstance may or may not occur, and that the description includes instances where the event or circumstance occurs and instances in which it does not. One of ordinary skill in the art would understand that with respect to any molecule described as containing one or more optional substituents, only sterically practical and/or synthetically feasible compounds are meant to be included.

As used herein, “optionally substituted” refers to all subsequent modifiers in a term or series of chemical groups. For example, in the term “optionally substituted arylalkyl, the “alkyl” portion and the “aryl” portion of the molecule may or may not be substituted, and for the series “optionally substituted alkyl, cycloalkyl, aryl and heteroaryl,” the alkyl, cycloalkyl, aryl, and heteroaryl groups, independently of the others, may or may not be substituted.

As used herein, “protecting group” refers to a group of atoms that mask, reduce or prevent the reactivity of the functional group when attached to a reactive functional group in a molecule. Typically, a protecting group may be selectively removed as desired during the course of a synthesis. Examples of protecting groups are well-known in the art. Functional groups that can have a protecting group include, but are not limited to, hydroxy, amino, and carboxy groups. Representative amino protecting groups include, but are not limited to, formyl, acetyl, trifluoroacetyl, benzyl, benzyloxycarbonyl (“CBZ”), tert-butoxycarbonyl (“Boc”), trimethylsilyl (“TMS”), 2-trimethylsilyl-ethanesulfonyl (“SES”), trityl and substituted trityl groups, allyloxycarbonyl, 9-fluorenylmethyloxycarbonyl (“FMOC”), nitro-veratryloxycarbonyl (“NVOC”) and the like. Representative hydroxyl protecting groups include, but are not limited to, those where the hydroxyl group is either acylated (e.g., methyl and ethyl esters, acetate or propionate groups or glycol esters) or alkylated such as benzyl and trityl ethers, as well as alkyl ethers, tetrahydropyranyl ethers, trialkylsilyl ethers (e.g., TMS or TIPPS groups) and allyl ethers. Other protecting groups can be found in the references noted herein.

Engineered Carboxyesterase Polypeptides

The present invention provides engineered polypeptides having carboxyesterase activity (also referred to herein as “engineered carboxyesterase polypeptides”) useful for hydrolysis reactions. Accordingly, in one aspect, the present invention provides engineered polypeptides having carboxyesterase activity which are capable of converting substrate compound(s) to product compound(s) as shown in Schemes 1 and 2, below. Further, the present invention provides polynucleotides encoding the engineered polypeptides, associated vectors and host cells comprising the polynucleotides, methods for making the engineered polypeptides, and methods for using the engineered polypeptides, including suitable reaction conditions.

The engineered polypeptides of the present invention are non-naturally occurring carboxyesterases engineered to have improved enzyme properties (e.g., increased enantioselectivity and increased kinetic resolution of a racemic substrate) as compared to the wild-type carboxyesterase polypeptide of *Xanthomonas campestris* (GenBank Acc. No. WP_011038606.1; SEQ ID NO: 2). The wild-type carboxyesterase polypeptide of SEQ ID NO: 2 is an alpha-beta hydrolase that hydrolyses ester substrates into corresponding acid and alcohol products using a molecule of water ($H_2O$). In some embodiments, various engineered carboxyesterase polypeptides provided herein exhibit improved enzyme properties as compared to other engineered reference carboxyesterase polypeptides provided herein.

Compound (1) is an intermediate in the synthesis of inhibitors of Factor XIa, a target for anti-thrombotic therapy (as disclosed in U.S. Pat. No. 9,453,018).

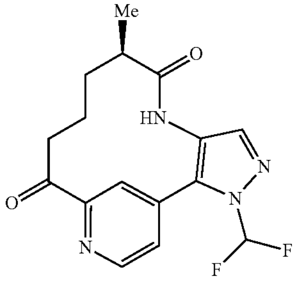 [SMILES: C[C@@H]1CCCC(=O)c2cc(ccn2)-c2c(cnn2C(F)F)NC1=O]

Compound (1). An intermediate in the synthesis of Factor XIa inhibitors.

Carboxyesterases are capable of a variety of reactions that are useful to efficiently produce pharmaceutical compounds and intermediates at industrial process conditions. Carboxyesterases and lipases may act as hydrolases for desirable transformations, including the transformation of esters to corresponding acids. One desirable reaction is the transformation (according to Scheme 1) of compound (2a) to produce compound (3a), an intermediate in the production of compound (1).

Scheme 1.
Transformation of racemic ester substrate, compounds (2a) and (2b).

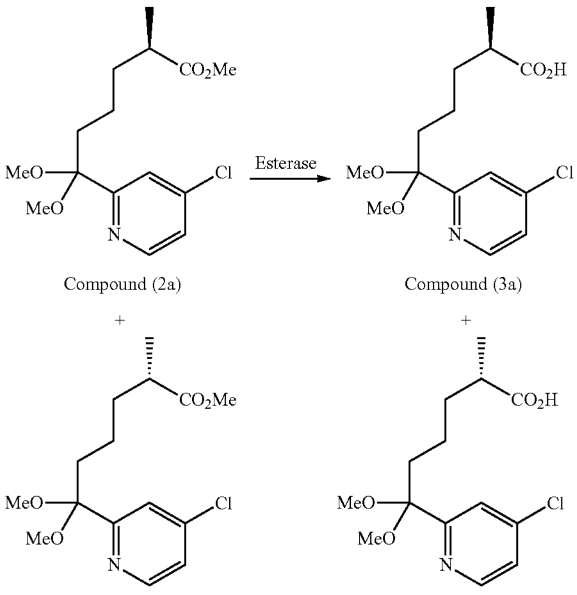

Compound (2a) Compound (3a)
+ +
Compound (2b) Compound (3b)

Compound (2a), an R-2 ester, exists in a racemic mixture with the S-2 enantiomer, compound (2b). Accordingly, an enzyme capable of kinetic resolution to produce either the R-2 acid, compound (3a), or R-2 ester, compound (2a) (which can then be hydrolyzed to produce compound (3a)) with high enantiomeric excess (e.e.) is highly desirable One method, alkylation of an Evans' oxazolidone derivative, installs the desired R-2 chiral center of compound (3a) with 86% enantiomeric excess over the undesired S-2 enantiomer of compound (3b). However, improved methods of producing compound (3a) with increased enantiomeric excess over compound (3b) are necessary to improve yields.

Under industrial process conditions, the racemic ester substrate exists as a mixture of compound (2a) and compound (2b). According to Scheme 2, an improved carboxyesterase with stereoselectivity for compound (2a) is depicted with high enantiomeric excess for the desired product of compound (3a), while the substrate compound (2b) remains unreacted. Thus, this kinetic resolution reaction has a maximum yield of 50% due to the racemic substrate. The minor product enantiomer (compound 3b) is not depicted. As a result, the reaction with a R-selective enzyme (E>200) yields mostly the desired acid (3a) and the unreacted ester (2b) at the end of the reaction.

Scheme 2. Transformation of the Racemic Ester Subtrate.

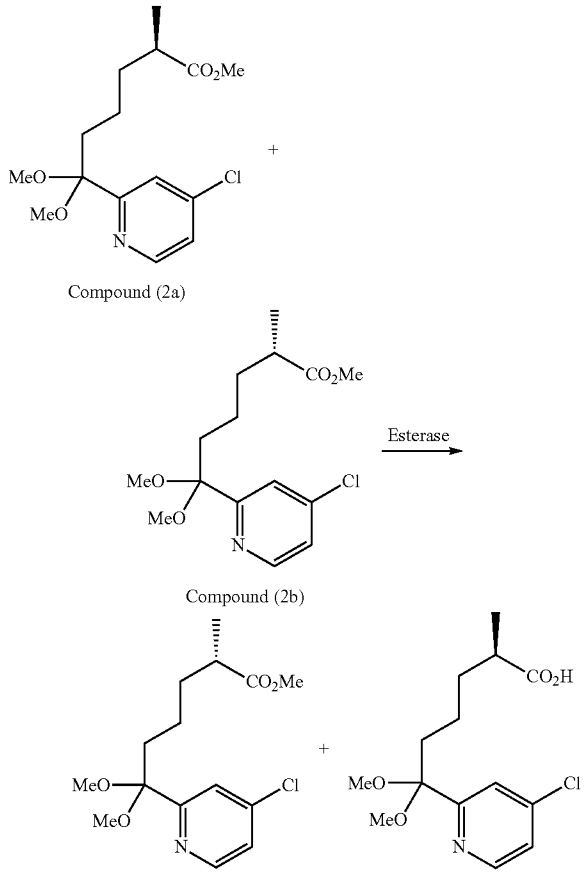

Compound (2a)

Compound (2b)

Compound (2b)

Compound (3a)

The present invention provides engineered carboxyesterases comprising polypeptide sequences having at least 80%, 85%, 86%, 87%, 88%, 89%, 90%, 91%, 92%, 93%, 94%, 95%, 96%, 97%, 98%, or 99% or more sequence identity to SEQ ID NO: 2 or a functional fragment thereof, wherein the engineered carboxyesterases comprise at least one substitution or substitution set in their polypeptide sequences, and wherein the amino acid positions of the polypeptide sequences are numbered with reference to SEQ ID NO: 2. In some embodiments, at least one substitution or substitution set in the polypeptide sequence comprises substitutions at positions selected from 3/4/6/9/10/11/36/38/70/82/180/200/214/229, 3/6/9/10/70/99, 3/8/9/10/11/13/70/82/107/229, 3/8/9/10/11/13/70/107, 3/8/9/10/11/70, 3/8/9/10/11/70/229, 3/8/9/10/13/70/82/107, 3/8/9/10/13/70/82/229, 3/8/9/10/70/82, 3/8/9/10/70/82/229, 3/8/9/10/70/229, 3/9/10/11/13/82, 3/9/10/11/70/82/107, 3/9/10/11/70/229, 3/9/10/70/82, 3/9/11, 3/9/11/70/82/180, 4/6/8/9/10/11/38/70/82/180/186/200/214/229, 4/6/9/10/11/36/70/82/180/200/214/229, 4/6/9/10/11/38/70/82/180/186/200/214, 4/6/9/10/70/82/229, 4/8/9/10/11/13/70/82/107/229, 4/8/9/10/11/36/38/70/82/180/200/214/229, 4/8/9/10/11/36/70/82/180/186/200/214/229, 4/8/9/10/11/70/82/180/200/214/229, 4/8/9/10/36/38/70/82/180/200/214/229, 4/9/10/11/36/38/70/82/180/200/214/229, 4/9/10/11/36/65/70/82/180/186/200/214, 4/9/10/11/36/70/82/180/200/214, 4/9/10/11/36/70/82/180/200/214/229, 4/9/10/11/70/82/180/200/214, 6/8/9/10/38/70/82/180/200/214, 6/9/10/11/36/70/82/180/200/214/229, 6/9/10/38/70/82/180/186/200/214/229, 6/9/10/70/82/180/186/200/214/229, 8/9/10, 8/9/10/11/13/70, 8/9/10/11/13/70/82, 8/9/10/11/13/70/82/107/229, 8/9/10/11/36/38/70/82/180/200/214, 8/9/10/11/38/70/82/180/200/214/229, 8/9/10/11/43/70/82/180/200/214, 8/9/10/11/70, 8/9/10/11/70/82/107/229, 8/9/10/11/70/229, 8/9/10/70, 8/9/10/70/82/229, 9/10, 9/10/11/12/49/51/70/73/82/180/200/225, 9/10/11/12/49/70/73/82/180, 9/10/11/12/51/54/70/73/82/108/148/180/225, 9/10/11/12/51/54/70/73/82/110/180, 9/10/11/12/51/54/70/73/82/148/180/225, 9/10/11/12/51/70/73/82/148/180, 9/10/11/12/51/70/73/82/148/180/200/225, 9/10/11/12/51/70/73/110/148/180, 9/10/11/17/49/70/82/180/200, 9/10/11/17/49/70/82/180/219, 9/10/11/17/51/54/70/82/148/180/200, 9/10/11/17/51/54/70/82/180, 9/10/11/17/70/73/82/87/180/219, 9/10/11/17/70/82/148/180/219, 9/10/11/35/70/82/180/200/214, 9/10/11/36/38/65/70/82/180/200/214/229, 9/10/11/36/38/70/82/180/200/214, 9/10/11/36/38/70/82/180/200/214/229, 9/10/11/36/70/82/180/196/214, 9/10/11/36/70/82/180/200/214, 9/10/11/36/70/82/180/200/214/229, 9/10/11/38/70/82/180/186/200/214, 9/10/11/40/70/82/180/200/214, 9/10/11/49/51/54/70/82/87/108/110/148/180/219, 9/10/11/49/51/54/70/82/87/108/180, 9/10/11/49/51/54/70/82/110/148/180, 9/10/11/49/51/70/82/108/110/148/180, 9/10/11/49/54/70/82/87/148/180, 9/10/11/49/70/82/87/108/110/180/200, 9/10/11/49/70/82/87/180, 9/10/11/49/70/82/110/148/180/225, 9/10/11/51/54/70/73/82/108/110/180, 9/10/11/51/54/70/73/82/108/180/200/225, 9/10/11/51/54/70/73/82/110/148/180, 9/10/11/51/54/70/82/148/180, 9/10/11/51/70/82/110/180/192/219, 9/10/11/54/70/82/87/108/180, 9/10/11/54/70/82/87/180/192, 9/10/11/54/70/82/148/180/200, 9/10/11/54/70/82/180/200/214, 9/10/11/70, 9/10/11/70/71/82/180/200/214, 9/10/11/70/73/82/87/110/180, 9/10/11/70/73/82/108/148/180, 9/10/11/70/73/82/148/180, 9/10/11/70/73/82/148/180/192/200, 9/10/11/70/73/82/180/200/214, 9/10/11/70/82, 9/10/11/70/82/87/110/180/219, 9/10/11/70/82/100/180/200/214, 9/10/11/70/82/107, 9/10/11/70/82/108/180/200/214, 9/10/11/70/82/148/180, 9/10/11/70/82/148/180/200/214, 9/10/11/70/82/180, 9/10/11/70/82/180/200/214, 9/10/11/70/87/180/200/214, 9/10/11/70/107, 9/10/12/49/51/54/70/82/108/148/180/225, 9/10/12/51/54/70/180/225, 9/10/12/51/70/73/82/148/180/200, 9/10/12/70/82/148/180/225, 9/10/12/70/82/180/200/214, 9/10/13/70, 9/10/13/70/82, 9/10/13/70/229, 9/10/13/207, 9/10/17, 9/10/17/49/51/54/70/73/82/108/110/148/180/192/200/219, 9/10/17/49/51/54/70/82/87/180/219, 9/10/17/49/70/82/148/180, 9/10/17/51/54/70/82/87/108/110/180/200, 9/10/17/51/70/73/82/87/108/110/148/180/219, 9/10/17/54/70/73/82/87/108/110/148/180/200, 9/10/17/54/70/73/82/108/110/148/180, 9/10/17/54/70/82/

87/108/110/180, 9/10/17/70/73/82/87/180/219, 9/10/17/70/73/82/108/110/148/180/200, 9/10/17/70/82/87/148/180, 9/10/17/70/82/87/148/180/192/219, 9/10/17/70/82/108/148/180, 9/10/17/70/82/110/148/180, 9/10/17/70/82/110/148/180/200, 9/10/17/70/82/180/200/214, 9/10/17/70/104/160/165, 9/10/17/70/139/160/165, 9/10/26, 9/10/29/70, 9/10/36/70/82/180/200/214, 9/10/37, 9/10/38/70/82/180/200/214, 9/10/39, 9/10/39/186, 9/10/41, 9/10/45/70, 9/10/49/51/54/70/73/82/108/110/148/180/192, 9/10/49/51/54/70/73/82/148/180, 9/10/49/51/54/70/82/108/110/148/180/225, 9/10/49/51/54/70/82/110/148/180, 9/10/49/51/54/70/82/110/180, 9/10/49/51/54/70/82/148/180, 9/10/49/51/54/70/82/148/180/192, 9/10/49/51/70/82/108/148/180/219, 9/10/49/51/70/82/110/148/180, 9/10/49/51/70/82/180/225, 9/10/49/54/70/73/82/87/110/180, 9/10/49/54/70/82/87/110/180, 9/10/49/54/70/82/108/148/180/225, 9/10/49/70/73/82/87/108/148/180, 9/10/49/70/73/82/108/110/148/180/225, 9/10/49/70/82/87/148/180, 9/10/49/70/82/110/180/219, 9/10/51/54/70/73/82/108/180, 9/10/51/54/70/73/82/110/148/180, 9/10/51/54/70/73/82/110/180, 9/10/51/54/70/73/82/180/219, 9/10/51/54/70/73/82/180/225, 9/10/51/54/70/82/87/180, 9/10/51/54/70/82/148/180, 9/10/51/54/70/82/180, 9/10/51/54/70/82/180/200, 9/10/51/70/82/108/180, 9/10/51/70/82/110/180/200, 9/10/51/70/82/180/219, 9/10/54/70/73/82/108/148/180/192, 9/10/54/70/82/87/108/180/200, 9/10/54/70/82/180, 9/10/62, 9/10/70, 9/10/70/73/82/87/108/110/180, 9/10/70/73/82/87/180/192/219, 9/10/70/73/82/87/180/200, 9/10/70/73/82/108/110/148/180, 9/10/70/73/82/108/110/180/200/219, 9/10/70/73/82/108/148/180, 9/10/70/73/82/108/148/180/192, 9/10/70/73/82/108/148/180/192/219, 9/10/70/73/82/108/180, 9/10/70/73/82/148/180, 9/10/70/73/82/148/180/200, 9/10/70/73/82/180/192, 9/10/70/73/82/180/192/219, 9/10/70/82, 9/10/70/82/87/108/110/148/180/192/219, 9/10/70/82/87/108/110/180, 9/10/70/82/87/108/110/180/192, 9/10/70/82/87/180, 9/10/70/82/107, 9/10/70/82/107/229, 9/10/70/82/108/110/180/219, 9/10/70/82/108/180, 9/10/70/82/110/148/180, 9/10/70/82/110/180/219, 9/10/70/82/148/180, 9/10/70/82/148/180/200, 9/10/70/82/148/180/200/219, 9/10/70/82/180, 9/10/70/82/180/192/219, 9/10/70/82/180/200/214, 9/10/70/82/229, 9/10/70/92, 9/10/70/99, 9/10/70/99/229, 9/10/70/107/229, 9/10/70/156, 9/10/70/165, 9/10/70/229, 9/10/88, 9/10/90, 9/10/96, 9/10/107, 9/10/110, 9/10/111, 9/10/112, 9/10/133, 9/10/178, 9/10/185, 9/10/186, 9/10/196, 9/10/211, 9/10/226, 11/24, 11/24/219, and 11/36/206/208, wherein the amino acid positions of the polypeptide sequence are numbered with reference to SEQ ID NO: 2. In some additional embodiments, at least one substitution or substitution set in the polypeptide sequence comprises substitutions selected from: 3R/4R/6P/9C/10I/11I/36N/38Y/70W/82Q/180L/200A/214W/229M, 3R/6P/9C/10I/70W/99R, 3R/8G/9C/10I/11T/13E/70W/82Q/107F/229M, 3R/8G/9C/10I/11T/13E/70W/107F, 3R/8G/9C/10I/11T/70W, 3R/8G/9C/10I/11T/70W/229M, 3R/8G/9C/10I/13E/70W/82Q/107F, 3R/8G/9C/10I/13E/70W/82Q/229M, 3R/8G/9C/10I/70W/82Q, 3R/8G/9C/10I/70W/82Q/229M, 3R/8G/9C/10I/70W/229M, 3R/9C/10I/11I/13E/82Q, 3R/9C/10I/11T/70W/82Q/107F, 3R/9C/10I/11T/70W/229M, 3R/9C/10I/70W/82Q, 3R/9C/11I, 3R/9C/11I/70W/82Q/180L, 4R/6P/8G/9C/10I/11T/38Y/70W/82Q/180L/186F/200A/214W/229M, 4R/6P/9C/10I/11I/36N/70W/82Q/180L/200A/214W/229M, 4R/6P/9C/10I/11I/38Y/70W/82Q/180L/186F/200A/214W, 4R/6P/9C/10I/70W/82Q/229M, 4R/8G/9C/10I/11T/13E/70W/82Q/107F/229M, 4R/8G/9C/10I/11T/36N/38Y/70W/82Q/180L/200A/214W/229M, 4R/8G/9C/10I/11T/36N/70W/82Q/180L/186F/200A/214W/229M, 4R/8G/9C/10I/11T/70W/82Q/180L/200A/214W/229M, 4R/8G/9C/10I/36N/38Y/70W/82Q/180L/200A/214W/229M, 4R/9C/10I/11I/36N/38Y/70W/82Q/180L/200A/214W/229M, 4R/9C/10I/11T/36N/65I/70W/82Q/180L/186F/200A/214W, 4R/9C/10I/11T/36N/70W/82Q/180L/200A/214W, 4R/9C/10I/11T/36N/70W/82Q/180L/200A/214W/229M, 4R/9C/10I/11T/70W/82Q/180L/200A/214W, 6P/8G/9C/10I/38Y/70W/82Q/180L/200A/214W, 6P/9C/10I/11T/36N/70W/82Q/180L/200A/214W/229M, 6P/9C/10I/38Y/70W/82Q/180L/186F/200A/214W/229M, 6P/9C/10I/70W/82Q/180L/186F/200A/214W/229M, 8A/9C/10I, 8G/9C/10I/11T/13E/70W, 8G/9C/10I/11T/13E/70W/82Q, 8G/9C/10I/11T/13E/70W/82Q/107F/229M, 8G/9C/10/11T/36N/38Y/70W/82Q/180L/200A/214W, 8G/9C/10/11T/38Y/70W/82Q/180L/200A/214W/229M, 8G/9C/10I/11T/431/70W/82Q/180L/200A/214W, 8G/9C/10I/11T/70W, 8G/9C/10I/11T/70W/82Q/107F/229M, 8G/9C/10I/11T/70W/229M, 8G/9C/10I/70W, 8G/9C/10I/70W/82Q/229M, 9A/10I/70W/82Q/180L/200A/214W, 9C/10I, 9C/10I/11E/12P/51D/70W/73M/110M/148L/180L, 9C/10I/11E/17C/70W/82Q/148L/180L/219H, 9C/10I/11E/17H/51D/54S/70W/82Q/180L, 9C/10I/11E/17H/70W/73M/82Q/87P/180L/219H, 9C/10I/11E/17V/49S/70W/82Q/180L/200H, 9C/10I/11E/49S/51D/54S/70W/82A/110M/148L/180L, 9C/10I/11E/49S/51D/54S/70W/82Q/87P/108H/110M/148L/180L/219H, 9C/10I/11E/49S/51D/54S/70W/82Q/87P/108H/180L, 9C/10I/11E/49S/51D/70W/82Q/108H/110M/148L/180L, 9C/10I/11E/49S/54S/70W/82Q/87P/148L/180L, 9C/10I/11E/49S/70W/82Q/87P/108H/110M/180L/200H, 9C/10I/11E/49S/70W/82Q/87P/180L, 9C/10I/11E/49S/70W/82Q/110M/148L/180L/225S, 9C/10I/11E/51D/54S/70W/82Q/148L/180L, 9C/10I/11E/54S/70W/82Q/87P/180L/192M, 9C/10I/11E/54S/70W/82Q/148L/180L/200H, 9C/10I/11E/70W/73L/82Q/108H/148L/180L, 9C/10I/11E/70W/73L/82Q/148L/180L, 9C/10I/11E/70W/73M/82Q/87P/110M/180L, 9C/10I/11E/70W/73M/82Q/148L/180L, 9C/10I/11E/70W/73M/82Q/148L/180L/192M/200H, 9C/10I/11E/70W/82Q/87P/110M/180L/219H, 9C/10I/11E/70W/82Q/148L/180L, 9C/10I/11E/70W/82Q/180L, 9C/10I/11E/70W/82Q/180L/200A/214W, 9C/10I/11G/17C/49S/70W/82Q/180L/219H, 9C/10I/11G/17V/51D/54S/70W/82Q/148L/180L/200H, 9C/10I/11G/51D/54S/70W/73L/82Q/108H/110M/180L, 9C/10I/11G/51D/70W/82Q/110M/180L/192M/219H, 9C/10I/11G/54S/70W/82Q/87P/108H/180L, 9C/10I/11G/70W/82Q/180L/200A/214W, 9C/10I/11I/35G/70W/82Q/180L/200A/214W, 9C/10I/11I/35Q/70W/82Q/180L/200A/214W, 9C/10I/11I/35S/70W/82Q/180L/200A/214W, 9C/10I/11I/361/70W/82Q/180L/200A/214W, 9C/10I/11I/36N/38Y/651/70W/82Q/180L/200A/214W/229M, 9C/10I/11I/36N/38Y/70W/82Q/180L/200A/214W, 9C/10I/11I/36N/38Y/70W/82Q/180L/200A/214W/229M, 9C/10I/11I/36N/70W/82Q/180L/196E/214W, 9C/10I/11I/36S/70W/82Q/180L/200A/214W, 9C/10I/11I/40V/70W/82Q/180L/200A/214W, 9C/10I/11I/54D/70W/82Q/180L/200A/214W, 9C/10I/11I/54P/70W/82Q/180L/200A/214W, 9C/10I/11I/54S/70W/82Q/180L/200A/214W, 9C/10I/11I/70V/82Q/180L/200A/214W, 9C/10I/11I/70W, 9C/10I/11I/70W/71H/82Q/180L/200A/214W, 9C/10I/11I/70W/71R/82Q/180L/200A/214W, 9C/10I/11I/70W/73L/82Q/180L/200A/214W, 9C/10I/11I/70W/73M/82Q/180L/200A/214W, 9C/10I/11I/70W/73R/82Q/180L/200A/214W, 9C/10I/11I/70W/82A/180L/200A/214W, 9C/10I/11I/70W/82Q/100S/180L/200A/214W, 9C/10I/11I/70W/82Q/108R/180L/200A/214W, 9C/10I/11I/70W/82Q/148L/180L/200A/214W, 9C/10I/11I/70W/82Q/180L/200A/214W, 9C/10I/11I/70W/87V/180L/200A/214W, 9C/10I/11T/36N/38Y/70W/82Q/180L/200A/214W/229M, 9C/10I/11T/36N/70W/82Q/180L/200A/214W/229M, 9C/10I/11T/38Y/70W/82Q/180L/186F/200A/214W, 9C/10I/11T/70W, 9C/10I/11T/70W/82Q, 9C/10I/11T/70W/82Q/107F, 9C/10I/11T/70W/107F, 9C/10I/12P/49S/51D/54S/70W/82Q/108H/148L/180L/225S, 9C/10I/12P/51D/70W/73L/82Q/148L/180L/200H, 9C/10I/12P/70W/82Q/180L/200A/214W, 9C/10I/12V/70W/82Q/180L/200A/214W, 9C/10I/13E/70W, 9C/10I/13E/70W/82Q, 9C/10I/13E/70W/229M, 9C/10I/13E/207Q, 9C/10I/17A/70W/82Q/180L/200A/214W, 9C/10I/17C/51D/54S/70W/82Q/87P/108H/110M/180L/200H, 9C/10I/17C/70W/73L/82Q/108H/110M/148L/180L/200H, 9C/10I/17C/70W/82Q/87P/148L/180L/192M/219H, 9C/10I/17C/70W/82Q/180L/200A/214W, 9C/10I/17H/49S/51D/54S/70W/73M/82Q/108H/110M/148L/180L/192M/200H/219H, 9C/10I/17H/54S/70W/82Q/87P/108H/110M/180L, 9C/10I/17H/70W/82Q/110M/148L/180L, 9C/10I/17H/70W/82Q/180L/200A/214W, 9C/10I/17Q/70W/82Q/180L/200A/214W, 9C/10I/17S/70W/82Q/180L/200A/214W, 9C/10I/17V/49S/51D/54S/70W/82Q/87P/180L/219H, 9C/10I/17V/49S/70W/82Q/148L/180L, 9C/10I/17V/51D/70W/73M/82Q/87P/108H/110M/148L/180L/219H, 9C/10I/17V/54S/70W/73L/82Q/87P/108H/110M/148L/180L/200H, 9C/10I/17V/54S/70W/73L/82Q/108H/110M/148L/180L, 9C/10I/17V/70W/73M/82Q/87P/180L/219H, 9C/10I/17V/70W/82Q/87P/148L/180L, 9C/10I/17V/70W/82Q/108H/148L/180L, 9C/10I/17V/70W/82Q/110M/148L/180L/200H, 9C/10I/17V/70W/82Q/180L/200A/214W, 9C/10I/17V/70W/104M/160E/165Q, 9C/10I/17V/70W/139H/160G/165Q, 9C/10I/17W, 9C/10I/26G, 9C/10I/26T, 9C/10I/29G/70W, 9C/10I/36N/70W/82Q/180L/200A/214W, 9C/10I/37P, 9C/10I/38Y/70W/82Q/180L/200A/214W, 9C/10I/39A/186T, 9C/10I/39W, 9C/10I/41F, 9C/10I/41G, 9C/10I/41S, 9C/10I/45R/70W, 9C/10I/45T/70W, 9C/10I/49S/51D/54S/70W/73M/82Q/148L/180L, 9C/10I/49S/51D/54S/70W/82G/108H/110M/148L/180L/225S, 9C/10I/49S/51D/54S/70W/82Q/110M/148L/180L, 9C/10I/49S/51D/54S/70W/82Q/110M/180L, 9C/10I/49S/51D/54S/70W/82Q/148L/180L, 9C/10I/49S/51D/54S/70W/82Q/148L/180L/192M, 9C/10I/49S/51D/70W/82Q/108H/148L/180L/219H, 9C/10I/49S/51D/70W/82Q/110M/148L/180L, 9C/10I/49S/51D/70W/82Q/180L/225S, 9C/10I/49S/54S/70W/73L/82Q/87P/110M/180L, 9C/10I/49S/54S/70W/82Q/87P/110M/180L, 9C/10I/49S/54S/70W/82Q/108H/148L/180L/225S, 9C/10I/49S/70W/73L/82G/108H/110M/148L/180L/225S, 9C/10I/49S/70W/73L/82Q/87P/108H/148L/180L, 9C/10I/49S/70W/82Q/87P/148L/180L, 9C/10I/49S/70W/82Q/110M/180L/219H, 9C/10I/51D/54S/70W/73L/82Q/108H/180L, 9C/10I/51D/54S/70W/73L/82Q/110M/148L/180L, 9C/10I/51D/54S/70W/73M/82Q/110M/180L, 9C/10I/51D/54S/70W/73M/82Q/180L/219H, 9C/10I/51D/54S/70W/73M/82Q/180L/225S, 9C/10I/51D/54S/70W/82Q/87P/180L, 9C/10I/51D/54S/70W/82Q/148L/180L, 9C/10I/51D/54S/70W/82Q/180L, 9C/10I/51D/54S/70W/82Q/180L/200H, 9C/10I/51D/70W/82Q/108H/180L, 9C/10I/51D/70W/82Q/110M/180L/200H, 9C/10I/51D/70W/82Q/180L/219H, 9C/10I/54S/70W/73M/82Q/108H/148L/180L/192M, 9C/10I/54S/70W/82G/180L, 9C/10I/54S/70W/82Q/87P/108H/180L/200H, 9C/10I/54S/70W/82Q/180L, 9C/10I/62G, 9C/10I/70R, 9C/10I/70W, 9C/10I/70W/73L/82Q/87P/108H/110M/180L, 9C/10I/70W/73L/82Q/108H/148L/180L, 9C/10I/70W/73L/82Q/108H/148L/180L/192M, 9C/10I/70W/73L/82Q/108H/180L, 9C/10I/70W/73L/82Q/148L/180L/200H, 9C/10I/70W/73L/82Q/180L/192M, 9C/10I/70W/73L/82Q/180L/192M/219H, 9C/10I/70W/73M/82Q/87P/180L/192M/219H, 9C/10I/70W/73M/82Q/87P/180L/200H, 9C/10I/70W/73M/82Q/108H/110M/180L/200H/219H, 9C/10I/70W/73M/82Q/108H/148L/180L, 9C/10I/70W/73M/82Q/108H/148L/180L/192M/219H, 9C/10I/70W/73M/82Q/148L/180L, 9C/10I/70W/82Q, 9C/10I/70W/82Q/87P/108H/110M/148L/180L/192M/219H, 9C/10I/70W/82Q/87P/108H/110M/180L, 9C/10I/70W/82Q/87P/108H/110M/180L/192M, 9C/10I/70W/82Q/87P/180L, 9C/10I/70W/82Q/107F, 9C/10I/70W/82Q/107F/229M, 9C/10I/70W/82Q/108H/110M/180L/219H, 9C/10I/70W/82Q/108H/180L, 9C/10I/70W/82Q/110M/148L/180L, 9C/10I/70W/82Q/110M/180L/219H, 9C/10I/70W/82Q/148L/180L, 9C/10I/70W/82Q/148L/180L/200H, 9C/10I/70W/82Q/148L/180L/200H/219H, 9C/10I/70W/82Q/180L, 9C/10I/70W/82Q/180L/192M/219H, 9C/10I/70W/82Q/180L/200A/214W, 9C/10I/70W/82Q/229M, 9C/10I/70W/92R, 9C/10I/70W/99R, 9C/10I/70W/99R/229M, 9C/10I/70W/107F/229M, 9C/10I/70W/156E, 9C/10I/70W/165Q, 9C/10I/70W/229M, 9C/10I/88G, 9C/10I/90S, 9C/10I/96F, 9C/10I/107F, 9C/10I/110V, 9C/10I/111M, 9C/10I/112G, 9C/10I/133E, 9C/10I/133W, 9C/10I/178E, 9C/10I/185E, 9C/10I/186Q, 9C/10I/196Q, 9C/10I/196R, 9C/10I/196S, 9C/10I/211E, 9C/10I/226E, 9C/10I/226W, 9R/10I/11E/12P/51D/54S/70W/73L/82Q/110M/180L, 9R/10I/11E/12P/51D/70W/73M/82Q/148L/180L/200H/225S, 9R/10I/11E/12S/51D/54S/70W/73M/82Q/148L/180L/225S, 9R/10I/54S/70W/82Q/180L, 9R/10I/70W/82Q/180L/200A/214W, 9T/10I/11E/12N/49S/70W/73M/82Q/180L, 9T/10I/11E/12P/51D/70W/73L/82Q/148L/180L, 9T/10I/11G/12S/49S/51D/70W/73M/82Q/180L/200H/225S, 9T/10I/11G/51D/54S/70W/73L/82Q/108H/180L/200H/225S, 9T/10I/11G/51D/54S/70W/73L/82Q/110M/148L/180L, 9T/10I/11R/12P/51D/54S/70W/73L/82Q/108H/148L/180L/225S, 9T/10I/12P/70W/82A/148L/180L/225S, 9T/10I/12S/51D/54S/70W/180L/225S, 9T/10I/49S/51D/54S/70W/73M/82Q/108H/110M/148L/180L/192M, 9T/10I/70W/73L/82Q/108H/110M/148L/180L, 11L/24T, 11L/24T/219D, and 11L/36S/206F/208A, wherein the amino acid positions of the polypeptide sequence are numbered with reference to SEQ ID NO: 2. In some further embodiments, at least one substitution or substitution set in the polypeptide sequence comprises substitutions selected from: S3R/P4R/T6P/W9C/M10I/M11I/D36N/S38Y/N70W/V82Q/P180L/T200A/V214W/T229M, S3R/T6P/W9C/M10I/N70W/V99R, S3R/R8G/W9C/M10I/M11T/D13E/N70W/V82Q/A107F/T229M, S3R/R8G/W9C/M10I/M11T/D13E/N70W/A107F, S3R/R8G/W9C/M10I/M11T/N70W, S3R/R8G/W9C/M10I/M11T/N70W/T229M, S3R/R8G/W9C/M10I/D13E/N70W/V82Q/A107F, S3R/R8G/W9C/M10I/D13E/N70W/V82Q/T229M, S3R/R8G/W9C/M10I/N70W/V82Q, S3R/R8G/W9C/M10I/N70W/V82Q/T229M, S3R/R8G/W9C/M10I/N70W/T229M, S3R/W9C/M10I/M11I/D13E/V82Q, S3R/W9C/M10I/M11T/N70W/V82Q/A107F, S3R/W9C/M10I/M11T/N70W/T229M, S3R/W9C/M10I/N70W/V82Q, S3R/W9C/M11I, S3R/W9C/M11I/N70W/V82Q/P180L, P4R/T6P/R8G/W9C/M10I/M11T/S38Y/N70W/V82Q/P180L/A186F/T200A/V214W/T229M, P4R/T6P/W9C/M10I/M11I/D36N/N70W/V82Q/P180L/T200A/V214W/T229M, P4R/T6P/W9C/M10I/M11I/S38Y/N70W/V82Q/P180L/A186F/T200A/V214W, P4R/T6P/W9C/M10I/N70W/V82Q/T229M, P4R/R8G/W9C/M10I/M11T/D13E/N70W/V82Q/A107F/T229M, P4R/R8G/W9C/M10I/M11T/D36N/S38Y/N70W/V82Q/P180L/T200A/V214W/T229M, P4R/R8G/W9C/M10I/M11T/D36N/N70W/V82Q/P180L/A186F/T200A/V214W/T229M, P4R/R8G/W9C/M10I/M11T/N70W/V82Q/P180L/T200A/V214W/T229M, P4R/R8G/W9C/M10I/D36N/S38Y/N70W/V82Q/P180L/T200A/V214W/T229M, P4R/W9C/M10I/M11I/D36N/S38Y/N70W/V82Q/P180L/T200A/V214W/T229M, P4R/W9C/M10I/M11T/D36N/R65I/N70W/V82Q/P180L/A186F/T200A/V214W, P4R/W9C/M10I/M11T/D36N/

N70W/V82Q/P180L/T200A/V214W, P4R/W9C/M10I/M11T/D36N/N70W/V82Q/P180L/T200A/V214W/T229M, P4R/W9C/M10I/M11T/N70W/V82Q/P180L/T200A/V214W, T6P/R8G/W9C/M10I/S38Y/N70W/V82Q/P180L/T200A/V214W, T6P/W9C/M10I/M11T/D36N/N70W/V82Q/P180L/T200A/V214W/T229M, T6P/W9C/M10I/S38Y/N70W/V82Q/P180L/A186F/T200A/V214W/T229M, T6P/W9C/M10I/N70W/V82Q/P180L/A186F/T200A/V214W/T229M, R8A/W9C/M10I, R8G/W9C/M10I/M11T/D13E/N70W, R8G/W9C/M10I/M11T/D13E/N70W/V82Q, R8G/W9C/M10I/M11T/D13E/N70W/V82Q/A107F/T229M, R8G/W9C/M10I/M11T/D36N/S38Y/N70W/V82Q/P180L/T200A/V214W, R8G/W9C/M10I/M11T/S38Y/N70W/V82Q/P180L/T200A/V214W/T229M, R8G/W9C/M10I/M11T/M43I/N70W/V82Q/P180L/T200A/V214W, R8G/W9C/M10I/M11T/N70W, R8G/W9C/M10I/M11T/N70W/V82Q/A107F/T229M, R8G/W9C/M10I/M11T/N70W/T229M, R8G/W9C/M10I/N70W, R8G/W9C/M10I/N70W/V82Q/T229M, W9A/M10I/N70W/V82Q/P180L/T200A/V214W, W9C/M10I, W9C/M10I/M11E/L12P/Q51D/N70W/V73M/Q110M/M148L/P180L, W9C/M10I/M11E/R17C/N70W/V82Q/M148L/P180L/A219H, W9C/M10I/M11E/R17H/Q51D/A54S/N70W/V82Q/P180L, W9C/M10I/M11E/R17H/N70W/V73M/V82Q/A87P/P180L/A219H, W9C/M10I/M11E/R17V/R49S/N70W/V82Q/P180L/T200H, W9C/M10I/M11E/R49S/Q51D/A54S/N70W/V82A/Q10M/M148L/P180L, W9C/M10I/M11E/R49S/Q51D/A54S/N70W/V82Q/A87P/N108H/Q10M/M148L/P180L/A219H, W9C/M10I/M11E/R49S/Q51D/A54S/N70W/V82Q/A87P/N108H/P180L, W9C/M10I/M11E/R49S/Q51D/N70W/V82Q/N108H/Q110M/M148L/P180L, W9C/M10I/M11E/R49S/A54S/N70W/V82Q/A87P/M148L/P180L, W9C/M10I/M11E/R49S/N70W/V82Q/A87P/N108H/Q10M/P180L/T200H, W9C/M10I/M11E/R49S/N70W/V82Q/A87P/P180L, W9C/M10I/M11E/R49S/N70W/V82Q/Q10M/M148L/P180L/Q225S, W9C/M10I/M11E/Q51D/A54S/N70W/V82Q/M148L/P180L, W9C/M10I/M11E/A54S/N70W/V82Q/A87P/P180L/Q192M, W9C/M10I/M11E/A54S/N70W/V82Q/M148L/P180L/T200H, W9C/M10I/M11E/N70W/V73L/V82Q/N108H/M148L/P180L, W9C/M10I/M11E/N70W/V73L/V82Q/M148L/P180L, W9C/M10I/M11E/N70W/V73M/V82Q/A87P/Q110M/P180L, W9C/M10I/M11E/N70W/V73M/V82Q/M148L/P180L, W9C/M10I/M11E/N70W/V73M/V82Q/M148L/P180L/Q192M/T200H, W9C/M10I/M11E/N70W/V82Q/A87P/Q110M/P180L/A219H, W9C/M10I/M11E/N70W/V82Q/M148L/P180L, W9C/M10I/M11E/N70W/V82Q/P180L, W9C/M10I/M11E/N70W/V82Q/P180L/T200A/V214W, W9C/M10I/M1 IG/R17C/R49S/N70W/V82Q/P180L/A219H, W9C/M10I/M11G/R17V/Q51D/A54S/N70W/V82Q/M148L/P180L/T200H, W9C/M10I/M11G/Q51D/A54S/N70W/V73L/V82Q/N108H/Q110M/P180L, W9C/M10I/M11G/Q51D/N70W/V82Q/Q110M/P180L/Q192M/A219H, W9C/M10I/M11G/A54S/N70W/V82Q/A87P/N108H/P180L, W9C/M10I/M11G/N70W/V82Q/P180L/T200A/V214W, W9C/M10I/M11I/A35G/N70W/V82Q/P180L/T200A/V214W, W9C/M10I/M11I/A35Q/N70W/V82Q/P180L/T200A/V214W, W9C/M10I/M11I/A35S/N70W/V82Q/P180L/T200A/V214W, W9C/M10I/M11I/D36I/N70W/V82Q/P180L/T200A/V214W, W9C/M10I/M11I/D36N/S38Y/R65I/N70W/V82Q/P180L/T200A/V214W/T229M, W9C/M10I/M11I/D36N/S38Y/N70W/V82Q/P180L/T200A/V214W, W9C/M10I/M11I/D36N/S38Y/N70W/V82Q/P180L/T200A/V214W/T229M, W9C/M10I/M11I/D36N/N70W/V82Q/P180L/A196E/V214W, W9C/M10I/M11I/D36S/N70W/V82Q/P180L/T200A/V214W, W9C/M10I/M11I/F40V/N70W/V82Q/P180L/T200A/V214W, W9C/M10I/M11I/A54D/N70W/V82Q/P180L/T200A/V214W, W9C/M10I/M11I/A54P/N70W/V82Q/P180L/T200A/V214W, W9C/M10I/M11I/A54S/N70W/V82Q/P180L/T200A/V214W, W9C/M10I/M11I/N70V/V82Q/P180L/T200A/V214W, W9C/M10I/M11I/N70W, W9C/M10I/M11I/N70W/N71H/V82Q/P180L/T200A/V214W, W9C/M10I/M11I/N70W/N71R/V82Q/P180L/T200A/V214W, W9C/M10I/M11I/N70W/V73L/V82Q/P180L/T200A/V214W, W9C/M10I/M11I/N70W/V73M/V82Q/P180L/T200A/V214W, W9C/M10I/M11I/N70W/V73R/V82Q/P180L/T200A/V214W, W9C/M10I/M11I/N70W/V82A/P180L/T200A/V214W, W9C/M10I/M11I/N70W/V82Q/A100S/P180L/T200A/V214W, W9C/M10I/M11I/N70W/V82Q/N108R/P180L/T200A/V214W, W9C/M10I/M11I/N70W/V82Q/M148L/P180L/T200A/V214W, W9C/M10I/M11I/N70W/V82Q/P180L/T200A/V214W, W9C/M10I/M11I/N70W/A87V/P180L/T200A/V214W, W9C/M10I/M11T/D36N/S38Y/N70W/V82Q/P180L/T200A/V214W/T229M, W9C/M10I/M11T/D36N/N70W/V82Q/P180L/T200A/V214W/T229M, W9C/M10I/M11T/S38Y/N70W/V82Q/P180L/A186F/T200A/V214W, W9C/M10I/M11T/N70W, W9C/M10I/M11T/N70W/V82Q, W9C/M10I/M11T/N70W/V82Q/A107F, W9C/M10I/M1 IT/N70W/A107F, W9C/M10I/L12P/R49S/Q51D/A54S/N70W/V82Q/N108H/M148L/P180L/Q225S, W9C/M10I/L12P/Q51D/N70W/V73L/V82Q/M148L/P180L/T200H, W9C/M10I/L12P/N70W/V82Q/P180L/T200A/V214W, W9C/M10I/L12V/N70W/V82Q/P180L/T200A/V214W, W9C/M10I/D13E/N70W, W9C/M10I/D13E/N70W/V82Q, W9C/M10I/D13E/N70W/T229M, W9C/M10I/D13E/P207Q, W9C/M10I/R17A/N70W/V82Q/P180L/T200A/V214W, W9C/M10I/R17C/Q51D/A54S/N70W/V82Q/A87P/N108H/Q110M/P180L/T200H, W9C/M10I/R17C/N70W/V73L/V82Q/N108H/Q110M/M148L/P180L/T200H, W9C/M10I/R17C/N70W/V82Q/A87P/M148L/P180L/Q192M/A219H, W9C/M10I/R17C/N70W/V82Q/P180L/T200A/V214W, W9C/M10I/R17H/R49S/Q51D/A54S/N70W/V73M/V82Q/N108H/Q110M/M148L/P180L/Q192M/T 200H/A219H, W9C/M10I/R17H/A54S/N70W/V82Q/A87P/N108H/Q110M/P180L, W9C/M10I/R17H/N70W/V82Q/Q110M/M148L/P180L, W9C/M10I/R17H/N70W/V82Q/P180L/T200A/V214W, W9C/M10I/R17Q/N70W/V82Q/P180L/T200A/V214W, W9C/M10I/R17S/N70W/V82Q/P180L/T200A/V214W, W9C/M10I/R17V/R49S/Q51D/A54S/N70W/V82Q/A87P/P180L/A219H, W9C/M10I/R17V/R49S/N70W/V82Q/M148L/P180L, W9C/M10I/R17V/Q51D/N70W/V73M/V82Q/A87P/N108H/Q110M/M148L/P180L/A219H, W9C/M10I/R17V/A54S/N70W/V73L/V82Q/A87P/N108H/Q110M/M148L/P180L/T200H, W9C/M10I/R17V/A54S/N70W/V73L/V82Q/N108H/Q110M/M148L/P180L, W9C/M10I/R17V/N70W/V73M/V82Q/A87P/P180L/A219H, W9C/M10I/R17V/N70W/V82Q/A87P/M148L/P180L, W9C/M10I/R17V/N70W/V82Q/N108H/M148L/P180L, W9C/M10I/R17V/N70W/V82Q/Q110M/M148L/P180L/T200H, W9C/M10I/R17V/N70W/V82Q/P180L/T200A/V214W, W9C/M10I/R17V/N70W/A104M/S160E/G165Q, W9C/M10I/R17V/N70W/R139H/S160G/G165Q, W9C/M10I/R17W, W9C/M10I/A26G, W9C/M10I/A26T, W9C/M10I/W29G/N70W, W9C/M10I/D36N/N70W/V82Q/P180L/T200A/V214W, W9C/M10I/G37P, W9C/M10I/S38Y/N70W/V82Q/P180L/T200A/V214W, W9C/M10I/D39A/A186T, W9C/M10I/D39W, W9C/M10I/A41F, W9C/M10I/A41G, W9C/M10I/A41S, W9C/M10I/P45R/N70W, W9C/M10I/P45T/N70W, W9C/M10I/R49S/Q51D/A54S/N70W/V73M/V82Q/M148L/P180L, W9C/M10I/R49S/Q51D/

A54S/N70W/V82G/N108H/Q110M/M148L/P180L/Q225S, W9C/M10I/R49S/Q51D/A54S/N70W/V82Q/Q110M/M148L/P180L, W9C/M10I/R49S/Q51D/A54S/N70W/V82Q/Q110M/P180L, W9C/M10I/R49S/Q51D/A54S/N70W/V82Q/M148L/P180L, W9C/M10I/R49S/Q51D/A54S/N70W/V82Q/M148L/P180L/Q192M, W9C/M10I/R49S/Q51D/N70W/V82Q/N108H/M148L/P180L/A219H, W9C/M10I/R49S/Q51D/N70W/V82Q/Q110M/M148L/P180L, W9C/M10I/R49S/Q51D/N70W/V82Q/P180L/Q225S, W9C/M10I/R49S/A54S/N70W/V73L/V82Q/A87P/Q110M/P180L, W9C/M10I/R49S/A54S/N70W/V82Q/A87P/Q110M/P180L, W9C/M10I/R49S/A54S/N70W/V82Q/N108H/M148L/P180L/Q225S, W9C/M10I/R49S/N70W/V73L/V82G/N108H/Q110M/M148L/P180L/Q225S, W9C/M10I/R49S/N70W/V73L/V82Q/A87P/N108H/M148L/P180L, W9C/M10I/R49S/N70W/V82Q/A87P/M148L/P180L, W9C/M10I/R49S/N70W/V82Q/Q110M/P180L/A219H, W9C/M10I/Q51D/A54S/N70W/V73L/V82Q/N108H/P180L, W9C/M10I/Q51D/A54S/N70W/V73L/V82Q/Q110M/M148L/P180L, W9C/M10I/Q51D/A54S/N70W/V73M/V82Q/Q110M/P180L, W9C/M10I/Q51D/A54S/N70W/V73M/V82Q/P180L/A219H, W9C/M10I/Q51D/A54S/N70W/V73M/V82Q/P180L/Q225S, W9C/M10I/Q51D/A54S/N70W/V82Q/A87P/P180L, W9C/M10I/Q51D/A54S/N70W/V82Q/M148L/P180L, W9C/M10I/Q51D/A54S/N70W/V82Q/P180L, W9C/M10I/Q51D/A54S/N70W/V82Q/P180L/T200H, W9C/M10I/Q51D/N70W/V82Q/N108H/P180L, W9C/M10I/Q51D/N70W/V82Q/Q110M/P180L/T200H, W9C/M10I/Q51D/N70W/V82Q/P180L/A219H, W9C/M10I/A54S/N70W/V73M/V82Q/N108H/M148L/P180L/Q192M, W9C/M10I/A54S/N70W/V82G/P180L, W9C/M10I/A54S/N70W/V82Q/A87P/N108H/P180L/T200H, W9C/M10I/A54S/N70W/V82Q/P180L, W9C/M10I/A62G, W9C/M10I/N70R, W9C/M10I/N70W, W9C/M10I/N70W/V73L/V82Q/A87P/N108H/Q110M/P180L, W9C/M10I/N70W/V73L/V82Q/N108H/M148L/P180L, W9C/M10I/N70W/V73L/V82Q/N108H/M148L/P180L/Q 192M, W9C/M10I/N70W/V73L/V82Q/N108H/P180L, W9C/M10I/N70W/V73L/V82Q/M148L/P180L/T200H, W9C/M10I/N70W/V73L/V82Q/P180L/Q192M, W9C/M10I/N70W/V73L/V82Q/P180L/Q192M/A219H, W9C/M10I/N70W/V73M/V82Q/A87P/P180L/Q192M/A219H, W9C/M10I/N70W/V73M/V82Q/A87P/P180L/T200H, W9C/M10I/N70W/V73M/V82Q/N108H/Q110M/P180L/T200H/A219H, W9C/M10I/N70W/V73M/V82Q/N108H/M148L/P180L, W9C/M10I/N70W/V73M/V82Q/N108H/M148L/P180L/Q192M/A219H, W9C/M10I/N70W/V73M/V82Q/M148L/P180L, W9C/M10I/N70W/V82Q, W9C/M10I/N70W/V82Q/A87P/N108H/Q110M/M148L/P180L/Q192M/A219H, W9C/M10I/N70W/V82Q/A87P/N108H/Q110M/P180L, W9C/M10I/N70W/V82Q/A87P/N108H/Q110M/P180L/Q192M, W9C/M10I/N70W/V82Q/A87P/P180L, W9C/M10I/N70W/V82Q/A107F, W9C/M10I/N70W/V82Q/A107F/T229M, W9C/M10I/N70W/V82Q/N108H/Q110M/P180L/A219H, W9C/M10I/N70W/V82Q/N108H/P180L, W9C/M10I/N70W/V82Q/Q110M/M148L/P180L, W9C/M10I/N70W/V82Q/Q110M/P180L/A219H, W9C/M10I/N70W/V82Q/M148L/P180L, W9C/M10I/N70W/V82Q/M148L/P180L/T200H, W9C/M10I/N70W/V82Q/M148L/P180L/T200H/A219H, W9C/M10I/N70W/V82Q/P180L, W9C/M10I/N70W/V82Q/P180L/Q192M/A219H, W9C/M10I/N70W/V82Q/P180L/T200A/V214W, W9C/M10I/N70W/V82Q/T229M, W9C/M10I/N70W/K92R, W9C/M10I/N70W/V99R, W9C/M10I/N70W/V99R/T229M, W9C/M10I/N70W/A107F/T229M, W9C/M10I/N70W/A156E, W9C/M10I/N70W/G165Q, W9C/M10I/N70W/T229M, W9C/M10I/Q88G, W9C/M10I/A90S, W9C/M10I/A96F, W9C/M10I/A107F, W9C/M10I/Q110V, W9C/M10I/A111M, W9C/M10I/R112G, W9C/M10I/A133E, W9C/M10I/A133W, W9C/M10I/A178E, W9C/M10I/R185E, W9C/M10I/A186Q, W9C/M10I/A196Q, W9C/M10I/A196R, W9C/M10I/A196S, W9C/M10I/Q211E, W9C/M10I/A226E, W9C/M10I/A226W, W9R/M10I/M11E/L12P/Q51D/A54S/N70W/V73L/V82Q/Q110M/P180L, W9R/M10I/M11E/L12P/Q51D/N70W/V73M/V82Q/M148L/P180L/T200H/Q225S, W9R/M10I/M11E/L12S/Q51D/A54S/N70W/V73M/V82Q/M148L/P180L/Q225S, W9R/M10I/A54S/N70W/V82Q/P180L, W9R/M10I/N70W/V82Q/P180L/T200A/V214W, W9T/M10I/M11E/L12N/R49S/N70W/V73M/V82Q/P180L, W9T/M10I/M11E/L12P/Q51D/N70W/V73L/V82Q/M148L/P180L, W9T/M10I/M11G/L12S/R49S/Q51D/N70W/V73M/V82Q/P180L/T200H/Q225S, W9T/M10I/M11 G/Q51D/A54S/N70W/V73L/V82Q/N108H/P180L/T200H/Q225S, W9T/M10I/M11G/Q51D/A54S/N70W/V73L/V82Q/Q110M/M148L/P180L, W9T/M10I/M11R/L12P/Q51D/A54S/N70W/V73L/V82Q/N108H/M148L/P180L/Q225S, W9T/M10I/L12P/N70W/V82A/M148L/P180L/Q225S, W9T/M10I/L12S/Q51D/A54S/N70W/P180L/Q225S, W9T/M10I/R49S/Q51D/A54S/N70W/V73M/V82Q/N108H/Q110M/M148L/P180L/Q192M, W9T/M10I/N70W/V73L/V82Q/N108H/Q110M/M148L/P180L, M11L/Q24T, M11L/Q24T/A219D, and M11L/D36S/Y206F/M208A, wherein the amino acid positions of the polypeptide sequence are numbered with reference to SEQ ID NO: 2.

The present invention also provides engineered carboxyesterases comprising polypeptide sequences having at least 80%, 85%, 86%, 87%, 88%, 89%, 90%, 91%, 92%, 93%, 94%, 95%, 96%, 97%, 98%, 99%, or more sequence identity to SEQ ID NO: 82 or a functional fragment thereof, wherein the engineered carboxyesterases comprise at least one substitution or substitution set in their polypeptide sequences, and wherein the amino acid positions of the polypeptide sequences are numbered with reference to SEQ ID NO: 82.

The present invention also provides engineered carboxyesterases comprising polypeptide sequences having at least 80%, 85%, 86%, 87%, 88%, 89%, 90%, 91%, 92%, 93%, 94%, 95%, 96%, 97%, 98%, or 99%, sequence identity to SEQ ID NO: 268 or a functional fragment thereof, wherein the engineered carboxyesterases comprise at least one substitution or substitution set in the polypeptide sequences, and wherein the amino acid positions of the polypeptide sequences are numbered with reference to SEQ ID NO: 268.

The present invention also provides engineered carboxyesterases comprising polypeptide sequences having at least 80%, 85%, 86%, 87%, 88%, 89%, 90%, 91%, 92%, 93%, 94%, 95%, 96%, 97%, 98%, or 99%, sequence identity to SEQ ID NO: 536 or a functional fragment thereof, wherein the engineered carboxyesterases comprise at least one substitution or substitution set in the polypeptide sequences, and wherein the amino acid positions of the polypeptide sequences are numbered with reference to SEQ ID NO: 536.

The present invention also provides engineered carboxyesterases comprising polypeptide sequences having at least 80%, 85%, 86%, 87%, 88%, 89%, 90%, 91%, 92%, 93%, 94%, 95%, 96%, 97%, 98%, or 99%, sequence identity to a sequence selected from the even-numbered sequences of SEQ ID NOs: 2-536 or a functional fragment thereof, wherein the engineered carboxyesterases comprise at least one substitution or substitution set in the polypeptide sequences, and wherein the amino acid positions of the polypeptide sequences are numbered with reference to a sequence selected from the even-numbered sequences of SEQ ID NOs: 2-536.

The present invention also provides engineered carboxyesterases comprising polypeptide sequences selected from the even-numbered sequences of SEQ ID NOs: 4-536.

In some embodiments, the engineered polypeptides possess modified properties that broaden the functionality and scope of activity of these enzymes as compared to the naturally occurring wild-type *X. campestris* carboxyesterase (SEQ ID NO: 2). The improved carboxyesterase properties include, but are not limited to: solvent stability, enzymatic activity, kinetic resolution, enantioselectivity, regiospecificity, stereoselectivity, reduced host cell toxicity, thermal stability, pH stability, substrate scope, and/or reduced substrate or product inhibition.

The improved properties of the carboxyesterase variants presented are related to the engineered polypeptides containing residue differences at specific residue positions as compared to the reference carboxyesterase sequence of *X. campestris* or another referred engineered polypeptide, such as the sequence of SEQ ID NO: 2. In some embodiments, the residue differences are present at least one of the following amino acid positions: X9, X10, X11, X17, X70, X82, X180, X200, and X214.

In some embodiments, the engineered carboxyesterases provided herein are characterized as exhibiting increased enzymatic activity as compared to a wild-type polypeptide or another reference polypeptide under the same reaction conditions. The engineered carboxyesterases are capable of increased enantioselectivity as indicated by increased e.e. of compound (3a) over compound (3b) as compared to a wild-type or reference carboxyesterase. In some embodiments, the engineered carboxyesterase polypeptides have increased enantiospecificity as measured by an increased E-value. In some embodiments, the engineered carboxyesterase polypeptides maintain or have increased activity under conditions with various pH levels (e.g., pH 9.0), as compared to a wild-type or reference carboxyesterase. In some embodiments, the engineered polypeptides with increased activity and/or increased enantiospecificity comprise an amino acid sequence that is at least 80%, 82%, 85%, 86%, 87%, 88%, 89%, 90%, 91%, 92%, 93%, 94%, 95%, 96%, 97%, 98%, 99%, or more identical to the reference sequence of SEQ ID NOs: 2, 82, 268, and/or 536.

In some embodiments, the engineered carboxyesterases are capable of biocatalytic activity improvements for converting the substrate compound(s) to product(s) at least about 1 fold, 1.2-fold, 1.5-fold, 2-fold, 3-fold, 4-fold, 5-fold, 10-fold, 20-fold, 30-fold, 40-fold, 50-fold, 150-fold, 500-fold or more relative to the activity of wild-type carboxyesterase (SEQ ID NO: 2) or a reference engineered carboxyesterase (SEQ ID NOs: 82, 268, and 536), under suitable reaction conditions. In some embodiments, these improvements in enzyme activity extend to associated increases in thermostability, stereoselectivity, stereospecificity, regiospecificity, enantioselectivity, solvent stability, pH stability, and/or substrate binding, or reduced substrate and/or product inhibition.

In some embodiments, the present invention also provides engineered carboxyesterase polypeptides that comprise a fragment of any of the engineered carboxyesterase polypeptides described herein that retains the functional carboxyesterase activity and/or improved property of that engineered carboxyesterase polypeptide. Accordingly, in some embodiments, the present invention provides a polypeptide fragment having carboxyesterase activity (e.g., capable of converting substrate to product under suitable reaction conditions), wherein the fragment comprises at least about 80%, 90%, 95%, 98%, or 99% of a full-length amino acid sequence of an engineered polypeptide of the present invention, such as an exemplary engineered polypeptide of having the even-numbered sequence identifiers of SEQ ID NOS: 2-536.

In some embodiments, the engineered carboxyesterase polypeptide of the invention comprises an amino acid sequence comprising at least one deletion, addition, and/or substitution, as compared to any one of the engineered carboxyesterase polypeptide sequences described herein, such as the exemplary engineered polypeptide sequences having the even-numbered sequence identifiers of SEQ ID NOS: 2-536. Thus, for each and every embodiment of the engineered carboxyesterase polypeptides of the invention, the amino acid sequence can comprise deletions, additions, and/or substitutions of one or more amino acids, 2 or more amino acids, 3 or more amino acids, 4 or more amino acids, 5 or more amino acids, 6 or more amino acids, 8 or more amino acids, 10 or more amino acids, 15 or more amino acids, or 20 or more amino acids, up to 10% of the total number of amino acids, up to 10% of the total number of amino acids, up to 20% of the total number of amino acids, or up to 30% of the total number of amino acids of the carboxyesterase polypeptides, where the associated functional activity and/or improved properties of the engineered carboxyesterase described herein is maintained. In some embodiments, the deletions, additions, and/or substitutions can comprise 1-2, 1-3, 1-4, 1-5, 1-6, 1-7, 1-8, 1-9, 1-10, 1-15, 1-20, 1-21, 1-22, 1-23, 1-24, 1-25, 1-30, 1-35, 1-40, 1-45, 1-50, 1-55, or 1-60 additions, and/or substitutions of the amino acid residues. In some embodiments, the number of deletions, additions, and/or substitutions can be 1, 2, 3, 4, 5, 6, 7, 8, 9, 10, 11, 12, 13, 14, 15, 16, 17, 18, 19, 20, 21, 22, 23, 24, 25, 30, 30, 35, 40, 45, 50, 55, or 60 of the amino acid residues. In some embodiments, the deletions, additions, and/or substitutions can comprise deletions, additions, and/or substitutions of 1, 2, 3, 4, 5, 6, 7, 8, 9, 10, 11, 12, 13, 14, 15, 16, 18, 20, 21, 22, 23, 24, 25 or 30 amino acid residues.

In some embodiments, the present invention provides an engineered carboxyesterase polypeptide having an amino acid sequence comprising an insertion as compared to any one of the engineered carboxyesterase polypeptide sequences described herein, such as the exemplary engineered polypeptide sequences having the even-numbered sequence identifiers of SEQ ID NO: 2-536. Thus, for each and every embodiment of the carboxyesterase polypeptides of the invention, the insertions can comprise one or more amino acids, 2 or more amino acids, 3 or more amino acids, 4 or more amino acids, 5 or more amino acids, 6 or more amino acids, 8 or more amino acids, 10 or more amino acids, 15 or more amino acids, or 20 or more amino acids, where the associated functional activity and/or improved properties of the engineered carboxyesterase described herein is maintained. The insertions can be to amino or carboxy terminus, or internal portions of the carboxyesterase polypeptide.

In some embodiments, the polypeptides of the present invention are in the form of fusion polypeptides in which the engineered polypeptides are fused to other polypeptides, such as, by way of example and not limitation, antibody tags (e.g., myc epitope), purification sequences (e.g., His tags for binding to metals), and cell localization signals (e.g., secretion signals). Thus, the engineered polypeptides described herein can be used with or without fusions to other polypeptides.

The engineered carboxyesterase polypeptides described herein are not restricted to the genetically encoded amino acids. Thus, in addition to the genetically encoded amino acids, the polypeptides described herein may be comprised, either in whole or in part, of naturally-occurring and/or synthetic non-encoded amino acids. Certain commonly encountered non-encoded amino acids of which the polypeptides described herein may be comprised include, but are not limited to: the D-stereoisomers of the genetically-encoded amino acids; 2,3-diaminopropionic acid (Dpr); α-aminoisobutyric acid (Aib); ε-aminohexanoic acid (Aha); δ-aminovaleric acid (Ava); N-methylglycine or sarcosine (MeGly or Sar); ornithine (Orn); citrulline (Cit); t-butylalanine (Bua); t-butylglycine (Bug); N-methylisoleucine (MeIle); phenylglycine (Phg); cyclohexylalanine (Cha); norleucine (Nle); naphthylalanine (Nal); 2-chlorophenylalanine (Ocf); 3-chlorophenylalanine (Mcf); 4-chlorophenylalanine (Pcf); 2-fluorophenylalanine (Off); 3-fluorophenylalanine (Mff); 4-fluorophenylalanine (Pff); 2-bromophenylalanine (Obf); 3-bromophenylalanine (Mbf); 4-bromophenylalanine (Pbf); 2-methylphenylalanine (Omf); 3-methylphenylalanine (Mmf); 4-methylphenylalanine (Pmf); 2-nitrophenylalanine (Onf); 3-nitrophenylalanine (Mnf); 4-nitrophenylalanine (Pnf); 2-cyanophenylalanine (Ocf); 3-cyanophenylalanine (Mcf); 4-cyanophenylalanine (Pcf); 2-trifluoromethylphenylalanine (Otf); 3-trifluoromethylphenylalanine (Mtf); 4-trifluoromethylphenylalanine (Ptf); 4-aminophenylalanine (Paf); 4-iodophenylalanine (Pif); 4-aminomethylphenylalanine (Pamf); 2,4-dichlorophenylalanine (Opef); 3,4-dichlorophenylalanine (Mpcf); 2,4-difluorophenylalanine (Opff); 3,4-difluorophenylalanine (Mpff); pyrid-2-ylalanine (2pAla); pyrid-3-ylalanine (3pAla); pyrid-4-ylalanine (4pAla); naphth-1-ylalanine (1nAla); naphth-2-ylalanine (2nAla); thiazolylalanine (taAla); benzothienylalanine (bAla); thienylalanine (tAla); furylalanine (fAla); homophenylalanine (hPhe); homotyrosine (hTyr); homotryptophan (hTrp); pentafluorophenylalanine (5ff); styrylkalanine (sAla); authrylalanine (aAla); 3,3-diphenylalanine (Dfa); 3-amino-5-phenypentanoic acid (Afp); penicillamine (Pen); 1,2,3,4-tetrahydroisoquinoline-3-carboxylic acid (Tic); β-2-thienylalanine (Thi); methionine sulfoxide (Mso); N(w)-nitroarginine (nArg); homolysine (hLys); phosphonomethylphenylalanine (pmPhe); phosphoserine (pSer); phosphothreonine (pThr); homoaspartic acid (hAsp); homoglutamic acid (hGlu); 1-aminocyclopent-(2 or 3)-ene-4 carboxylic acid; pipecolic acid (PA), azetidine-3-carboxylic acid (ACA); 1-aminocyclopentane-3-carboxylic acid; allylglycine (aOly); propargylglycine (pgGly); homoalanine (hAla); norvaline (nVal); homoleucine (hLeu), homovaline (hVal); homoisoleucine (hIle); homoarginine (hArg); N-acetyl lysine (AcLys); 2,4-diaminobutyric acid (Dbu); 2,3-diaminobutyric acid (Dab); N-methylvaline (MeVal); homocysteine (hCys); homoserine (hSer); hydroxyproline (Hyp) and homoproline (hPro). Additional non-encoded amino acids of which the polypeptides described herein may be comprised will be apparent to those of skill in the art. These amino acids may be in either the L- or D-configuration.

Those of skill in the art will recognize that amino acids or residues bearing side chain protecting groups may also comprise the polypeptides described herein. Non-limiting examples of such protected amino acids, which in this case belong to the aromatic category, include (protecting groups listed in parentheses), but are not limited to: Arg(tos), Cys(methylbenzyl), Cys (nitropyridinesulfenyl), Glu(δ-benzylester), Gln(xanthyl), Asn(N-δ-xanthyl), His(bom), His (benzyl), His(tos), Lys(finoc), Lys(tos), Ser(O-benzyl), Thr (O-benzyl) and Tyr(O-benzyl).

Non-encoding amino acids that are conformationally constrained of which the polypeptides described herein may be composed include, but are not limited to, N-methyl amino acids (L-configuration); 1-aminocyclopent-(2 or 3)-ene-4-carboxylic acid; pipecolic acid; azetidine-3-carboxylic acid; homoproline (hPro); and 1-aminocyclopentane-3-carboxylic acid.

As will be apparent to the skilled artisan, the foregoing residue positions and the specific amino acid residues for each residue position can be used individually or in various combinations to synthesize carboxyesterase polypeptides having desired improved properties, including, among others, enzyme activity, substrate/product preference, enantioselectivity, stereoselectivity, substrate/product tolerance, and stability under various conditions, such as increased temperature, solvent, and/or pH.

The engineered carboxyesterase polypeptides of the present invention were generated by directed evolution of SEQ ID NO: 2 for efficient hydrolysis of substrates of interest to products of interest, under certain industrially relevant conditions and have one or more residue differences as compared to a reference carboxyesterase polypeptide. These residue differences are associated with improvements in various enzyme properties, particularly increased activity and entantioselectivity. In some additional embodiments, the variant carboxyesterases also exhibited increased stereoselectivity, increased stability, and tolerance of increased substrate and/or product concentration (e.g., decreased product inhibition). Accordingly, in some embodiments, the engineered polypeptides having carboxyesterase activity are capable of converting the substrate compound(s) to product(s) with an activity that is increased at least about 1 fold, 1.2 fold, 1.5 fold, 2 fold, 3 fold, 4 fold, 5 fold, 10 fold, 20 fold, 30 fold, 40 fold, 50 fold, 100 fold, 200 fold, 500 fold, 1000 fold, or more relative to the activity of wild-type *X. campestris* carboxyesterase polypeptide (e.g., SEQ ID NO: 2), under suitable reaction conditions. In some embodiments, the engineered polypeptides having carboxyesterase activity are capable of converting substrate to product with a percent conversion of at least about 40%, at least about 41%, at least about 42%, at least about 43%, at least about 44%, at least about 45%, at least about 46%, at least about 47%, at least about 48%, at least about 49%, or at least about 50%, wherein the maximum conversion of the racemic substrate of compounds (2a) and (2b) to compound (3a) is 50%, in a reaction time of about 48 h, about 36 h, about 24 h, or even a shorter length of time, under suitable reaction conditions. In some embodiments, the engineered polypeptides having carboxyesterase activity are capable of converting substrate to product in enantiomeric excess of at least 90%, 95%, 97%, 98%, 99%, or greater, under suitable reaction conditions.

In some embodiments, the engineered polypeptides having carboxyesterase activity are capable of converting substrate to product with increased tolerance for the presence of the substrate relative to the substrate tolerance of a reference polypeptide (e.g., SEQ ID NO: 2), under suitable reaction conditions. Accordingly, in some embodiments the engineered polypeptides are capable of converting the substrate to product in the presence of a substrate loading concentration of at least about 1 g/L, 5 g/L, 10 g/L, 20 g/L, about 30 g/L, about 40 g/L, about 50 g/L, about 70 g/L, about 75 g/L, about 100 g/L, with a percent conversion of at least about 40%, at least about 41%, at least about 42%, at least about 43%, at least about 44%, at least about 45%, at least about 46%, at least about 47%, at least about 48%, at least about 49%, or at least about 50%, wherein the maximum conversion of the racemic substrate of compounds (2a) and (2b) to compound (3a) is 50%, in a reaction time of about 72 h, about 48h, about 36h, about 24 h, or even shorter length of time, under suitable reaction conditions.

Some suitable reaction conditions under which the above-described improved properties of the engineered polypeptides can be determined with respect to concentrations or amounts of polypeptide, substrate, buffer, co-solvent, pH, and/or conditions including temperature and reaction time are provided herein. In some embodiments, the suitable reaction conditions comprise the assay conditions described below and in the Examples.

In some embodiments, the engineered polypeptides can be provided on a solid support, such as a membrane, resin, solid carrier, or other solid phase material. A solid support can be composed of organic polymers such as polystyrene, polyethylene, polypropylene, polyfluoroethylene, polyethyleneoxy, and polyacrylamide, as well as co-polymers and grafts thereof. A solid support can also be inorganic, such as glass, silica, controlled pore glass (CPG), reverse phase silica or metal, such as gold or platinum. The configuration of a solid support can be in the form of beads, spheres, particles, granules, a gel, a membrane or a surface. Surfaces can be planar, substantially planar, or non-planar. Solid supports can be porous or non-porous, and can have swelling or non-swelling characteristics. A solid support can be configured in the form of a well, depression, or other container, vessel, feature, or location.

In some embodiments, the engineered polypeptides having carboxyesterase activity are bound or immobilized on the solid support such that they retain at least a portion of their improved properties relative to a reference polypeptide (e.g., SEQ ID NO: 2). In such embodiments, the immobilized polypeptides can facilitate the biocatalytic conversion of the substrate compound to the desired product, and after the reaction is complete are easily retained (e.g., by retaining beads on which polypeptide is immobilized) and then reused or recycled in subsequent reactions. Such immobilized enzyme processes allow for further efficiency and cost reduction. Accordingly, it is further contemplated that any of the methods of using the engineered carboxyesterase polypeptides of the present invention can be carried out using the same carboxyesterase polypeptides bound or immobilized on a solid support.

The engineered carboxyesterase polypeptide can be bound non-covalently or covalently. Various methods for conjugation and immobilization of enzymes to solid supports (e.g., resins, membranes, beads, glass, etc.) are well known in the art. Other methods for conjugation and immobilization of enzymes to solid supports (e.g., resins, membranes, beads, glass, etc.) are well known in the art (See, e.g., Yi et al., Proc. Biochem., 42: 895-898 [2007]; Martin et al., Appl. Microbiol. Biotechnol., 76: 843-851 [2007]; Koszelewski et al., *J. Mol. Cat. B: Enz.,* 63: 39-44 [2010]; Truppo et al., Org. Proc. Res. Develop., published online: dx.doi.org/10.1021/op200157c; and Mateo et al., Biotechnol. Prog., 18:629-34 [2002], etc.). Solid supports useful for immobilizing the engineered carboxyesterase polypeptides of the present invention include, but are not limited to, beads or resins comprising polymethacrylate with epoxide functional groups, polymethacrylate with amino epoxide functional groups, styrene/DVB copolymer or polymethacrylate with octadecyl functional groups. Exemplary solid supports useful for immobilizing the engineered carboxyesterases of the present invention include, but are not limited to, chitosan beads, Eupergit C, and SEPABEADs (Mitsubishi), including the following different types of SEPABEAD: EC-EP, EC-HFA/S, EXA252, EXE119 and EXE120.

In some embodiments, the engineered carboxyesterase polypeptides can be provided in the form of an array in which the polypeptides are arranged in positionally distinct locations. In some embodiments, the positionally distinct locations are wells in a solid support such as a 96-well plate. A plurality of supports can be configured on an array at various locations, addressable for robotic delivery of reagents, or by detection methods and/or instruments. Such arrays can be used to test a variety of substrate compounds for conversion by the polypeptides.

In some embodiments, the engineered polypeptides described herein can be provided in the form of kits. The polypeptides in the kits may be present individually or as a plurality of polypeptides. The kits can further include reagents for carrying out enzymatic reactions, substrates for assessing the activity of polypeptides, as well as reagents for detecting the products. The kits can also include reagent dispensers and instructions for use of the kits. In some embodiments, the kits of the present invention include arrays comprising a plurality of different engineered carboxyesterase polypeptides at different addressable position, wherein the different polypeptides are different variants of a reference sequence each having at least one different improved enzyme property. Such arrays comprising a plurality of engineered polypeptides and methods of their use are known (See, e.g., WO2009/008908A2).

Polynucleotides Encoding Engineered Carboxyesterases

In another aspect, the present invention provides polynucleotides encoding the engineered carboxyesterase enzymes. The polynucleotides may be operatively linked to one or more heterologous regulatory sequences that control gene expression to create a recombinant polynucleotide capable of expressing the polypeptide. Expression constructs containing a heterologous polynucleotide encoding the engineered carboxyesterase can be introduced into appropriate host cells to express the corresponding carboxyesterase polypeptide.

Because of the knowledge of the codons corresponding to the various amino acids, availability of a protein sequence provides a description of all the polynucleotides capable of encoding the subject. The degeneracy of the genetic code, where the same amino acids are encoded by alternative or synonymous codons allows an extremely large number of nucleic acids to be made, all of which encode the improved carboxyesterase enzymes disclosed herein. Thus, having identified a particular amino acid sequence, those skilled in the art could make any number of different nucleic acids by simply modifying the sequence of one or more codons in a way which does not change the amino acid sequence of the protein. In this regard, the present invention specifically contemplates each and every possible variation of polynucleotides that could be made by selecting combinations based on the possible codon choices, and all such variations are to be considered specifically disclosed for any polypeptide disclosed herein, including the amino acid sequences presented in the Tables in the Examples. In various embodiments, the codons are preferably selected to fit the host cell in which the protein is being produced. For example, preferred codons used in bacteria are used to express the gene in bacteria; preferred codons used in yeast are used for expression in yeast; and preferred codons used in mammals are used for expression in mammalian cells. By way of example, the polynucleotide of SEQ ID NO: 1 has been codon optimized for expression in *E. coli*, but otherwise encodes the naturally occurring carboxyesterase of *X. campestris*.

In some embodiments, the polynucleotide encodes an engineered carboxyesterase polypeptide comprising an amino acid sequence selected from the even-number sequence identifiers of SEQ ID NOS: 2-536.

In some embodiments, the polynucleotides encoding the engineered carboxyesterases or a functional fragment thereof, are selected from polynucleotide sequences comprising at least 85%, 86%, 87%, 88%, 89%, 90%, 91%, 92%, 93%, 94%, 95%, 96%, 97%, 98%, 99%, or more sequence identity to the odd-numbered sequence identifiers of SEQ ID NOS: 1-535.

In some embodiments, the polynucleotides are capable of hybridizing under highly stringent conditions to a polynucleotide comprising the odd-numbered sequence identifiers of SEQ ID NOS: 1-535.

In some embodiments, the polynucleotides encode the polypeptides described herein but have about 80% or more sequence identity, about 85%, 86%, 87%, 88%, 89%, 90%, 91%, 92%, 93%, 94%, 95%, 96%, 97%, 98%, or 99% or more sequence identity at the nucleotide level to a reference polynucleotide encoding the engineered carboxyesterase. In some embodiments, the reference polynucleotide comprises SEQ ID NO: 1, while in some other embodiments, the reference polynucleotide comprises SEQ ID NO: 81. In some further embodiments, the reference polynucleotide sequence comprises SEQ ID NO: 285. In some further embodiments, the reference polynucleotide sequence comprises SEQ ID NO: 535. In some additional embodiments, the engineered carboxyesterase sequences comprise sequences that comprise positions identified to be beneficial, as described in the Examples.

The present invention also provides polynucleotide sequences encoding at least one engineered carboxyesterase provided herein. In some embodiments, the polynucleotide sequences encode at least one engineered carboxyesterase comprising a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 2 or a functional fragment thereof, wherein the engineered carboxyesterase comprises at least one substitution or substitution set in its polypeptide sequence, wherein the amino acid positions of the polypeptide sequence are numbered with reference to SEQ ID NO: 2. In some embodiments, the polynucleotide sequences encode at least one engineered carboxyesterase comprising substitutions at positions selected from: 3/4/6/9/10/11/36/38/70/82/180/200/214/229, 3/6/9/10/70/99, 3/8/9/10/11/13/70/82/107/229, 3/8/9/10/11/13/70/107, 3/8/9/10/11/70, 3/8/9/10/11/70/229, 3/8/9/10/13/70/82/107, 3/8/9/10/13/70/82/229, 3/8/9/10/70/82, 3/8/9/10/70/82/229, 3/8/9/10/70/229, 3/9/10/11/13/82, 3/9/10/11/70/82/107, 3/9/10/11/70/229, 3/9/10/70/82, 3/9/11, 3/9/11/70/82/180, 4/6/8/9/10/11/38/70/82/180/186/200/214/229, 4/6/9/10/11/36/70/82/180/200/214/229, 4/6/9/10/11/38/70/82/180/186/200/214, 4/6/9/10/70/82/229, 4/8/9/10/11/13/70/82/107/229, 4/8/9/10/11/36/38/70/82/180/200/214/229, 4/8/9/10/11/36/70/82/180/186/200/214/229, 4/8/9/10/11/70/82/180/200/214/229, 4/8/9/10/36/38/70/82/180/200/214/229, 4/9/10/11/36/38/70/82/180/200/214/229, 4/9/10/11/36/65/70/82/180/186/200/214, 4/9/10/11/36/70/82/180/200/214, 4/9/10/11/36/70/82/180/200/214/229, 4/9/10/11/70/82/180/200/214, 6/8/9/10/38/70/82/180/200/214, 6/9/10/11/36/70/82/180/200/214/229, 6/9/10/38/70/82/180/186/200/214/229, 6/9/10/70/82/180/186/200/214/229, 8/9/10, 8/9/10/11/13/70, 8/9/10/11/13/70/82, 8/9/10/11/13/70/82/107/229, 8/9/10/11/36/38/70/82/180/200/214, 8/9/10/11/38/70/82/180/200/214/229, 8/9/10/11/43/70/82/180/200/214, 8/9/10/11/70, 8/9/10/11/70/82/107/229, 8/9/10/11/70/229, 8/9/10/70, 8/9/10/70/82/229, 9/10, 9/10/11/12/49/51/70/73/82/180/200/225, 9/10/11/12/49/70/73/82/180, 9/10/11/12/51/54/70/73/82/108/148/180/225, 9/10/11/12/51/54/70/73/82/110/180, 9/10/11/12/51/54/70/73/82/148/180/225, 9/10/11/12/51/70/73/82/148/180, 9/10/11/12/51/70/73/82/148/180/200/225, 9/10/11/12/51/70/73/110/148/180, 9/10/11/17/49/70/82/180/200, 9/10/11/17/49/70/82/180/219, 9/10/11/17/51/54/70/82/148/180/200, 9/10/11/17/51/54/70/82/180, 9/10/11/17/70/73/82/87/180/219, 9/10/11/17/70/82/148/180/219, 9/10/11/35/70/82/180/200/214, 9/10/11/36/38/65/70/82/180/200/214/229, 9/10/11/36/38/70/82/180/200/214, 9/10/11/36/38/70/82/180/200/214/229, 9/10/11/36/70/82/180/196/214, 9/10/11/36/70/82/180/200/214, 9/10/11/36/70/82/180/200/214/229, 9/10/11/38/70/82/180/186/200/214, 9/10/11/40/70/82/180/200/214, 9/10/11/49/51/54/70/82/87/108/110/148/180/219, 9/10/11/49/51/54/70/82/87/108/180, 9/10/11/49/51/54/70/82/110/148/180, 9/10/11/49/51/70/82/108/110/148/180, 9/10/11/49/54/70/82/87/148/180, 9/10/11/49/70/82/87/108/110/180/200, 9/10/11/49/70/82/87/180, 9/10/11/49/70/82/110/148/180/225, 9/10/11/51/54/70/73/82/108/110/180, 9/10/11/51/54/70/73/82/108/180/200/225, 9/10/11/51/54/70/73/82/110/148/180, 9/10/11/51/54/70/82/148/180, 9/10/11/51/70/82/110/180/192/219, 9/10/11/54/70/82/87/108/180, 9/10/11/54/70/82/87/180/192, 9/10/11/54/70/82/148/180/200, 9/10/11/54/70/82/180/200/214, 9/10/11/70, 9/10/11/70/71/82/180/200/214, 9/10/11/70/73/82/87/110/180, 9/10/11/70/73/82/108/148/180, 9/10/11/70/73/82/148/180, 9/10/11/70/73/82/148/180/192/200, 9/10/11/70/73/82/180/200/214, 9/10/11/70/82, 9/10/11/70/82/87/110/180/219, 9/10/11/70/82/100/180/200/214, 9/10/11/70/82/107, 9/10/11/70/82/108/180/200/214, 9/10/11/70/82/148/180, 9/10/11/70/82/148/180/200/214, 9/10/11/70/82/180, 9/10/11/70/82/180/200/214, 9/10/11/70/87/180/200/214, 9/10/11/70/107, 9/10/12/49/51/54/70/82/108/148/180/225, 9/10/12/51/54/70/180/225, 9/10/12/51/70/73/82/148/180/200, 9/10/12/70/82/148/180/225, 9/10/12/70/82/180/200/214, 9/10/13/70, 9/10/13/70/82, 9/10/13/70/229, 9/10/13/207, 9/10/17, 9/10/17/49/51/54/70/73/82/108/110/148/180/192/200/219, 9/10/17/49/51/54/70/82/87/180/219, 9/10/17/49/70/82/148/180, 9/10/17/51/54/70/82/87/108/110/180/200, 9/10/17/51/70/73/82/87/108/110/148/180/219, 9/10/17/54/70/73/82/87/108/110/148/180/200, 9/10/17/54/70/73/82/108/110/148/180, 9/10/17/54/70/82/87/108/110/180, 9/10/17/70/73/82/87/180/219, 9/10/17/70/73/82/108/110/148/180/200, 9/10/17/70/82/87/148/180, 9/10/17/70/82/87/148/180/192/219, 9/10/17/70/82/108/148/180, 9/10/17/70/82/110/148/180, 9/10/17/70/82/110/148/180/200, 9/10/17/70/82/180/200/214, 9/10/17/70/104/160/165, 9/10/17/70/139/160/165, 9/10/26, 9/10/29/70, 9/10/36/70/82/180/200/214, 9/10/37, 9/10/38/70/82/180/200/214, 9/10/39, 9/10/39/186, 9/10/41, 9/10/45/70, 9/10/49/51/54/70/73/82/108/110/148/180/192, 9/10/49/51/54/70/73/82/148/180, 9/10/49/51/54/70/82/108/110/148/180/225, 9/10/49/51/54/70/82/110/148/180, 9/10/49/51/54/70/82/110/180, 9/10/49/51/54/70/82/148/180, 9/10/49/51/54/70/82/148/180/192, 9/10/49/51/70/82/108/148/180/219, 9/10/49/51/70/82/110/148/180, 9/10/49/51/70/82/180/225, 9/10/49/54/70/73/82/87/110/180, 9/10/49/54/70/82/87/110/180, 9/10/49/54/70/82/108/148/180/225, 9/10/49/70/73/82/87/108/148/180, 9/10/49/70/73/82/108/110/148/180/225, 9/10/49/70/82/87/148/180, 9/10/49/70/82/110/180/219, 9/10/51/54/70/73/82/108/180, 9/10/51/54/70/73/82/110/148/180, 9/10/51/54/70/73/82/110/180, 9/10/51/54/70/73/82/180/219, 9/10/51/54/70/73/82/180/225, 9/10/51/54/70/82/87/180, 9/10/51/54/70/82/148/180, 9/10/51/54/70/82/180, 9/10/51/54/70/82/180/200, 9/10/51/70/82/108/180, 9/10/51/70/82/110/180/200, 9/10/51/70/82/180/219, 9/10/54/70/73/82/108/148/180/192, 9/10/54/70/82/87/108/180/200, 9/10/54/70/82/180, 9/10/62, 9/10/70, 9/10/70/73/82/87/108/110/180, 9/10/70/73/82/87/180/192/219, 9/10/70/73/82/87/180/200, 9/10/70/73/82/108/110/148/180, 9/10/70/73/82/108/110/180/200/219, 9/10/70/73/82/108/148/180, 9/10/70/73/82/108/148/180/192, 9/10/70/73/82/108/148/180/192/219, 9/10/70/73/82/108/180, 9/10/70/73/82/148/180, 9/10/70/73/82/148/180/200, 9/10/70/73/82/180/192, 9/10/70/73/82/180/192/219, 9/10/70/82, 9/10/70/82/87/108/110/148/180/192/219, 9/10/70/82/87/108/110/180, 9/10/70/82/87/108/110/180/192, 9/10/70/82/87/180, 9/10/70/82/107, 9/10/70/82/107/229, 9/10/70/82/108/110/180/219, 9/10/70/82/108/180, 9/10/70/82/110/148/180, 9/10/70/82/110/180/219, 9/10/70/82/148/180, 9/10/70/82/148/180/200, 9/10/70/82/148/180/200/219, 9/10/70/82/180, 9/10/70/82/180/192/219, 9/10/70/82/180/200/214, 9/10/70/82/229, 9/10/70/92, 9/10/70/99, 9/10/70/99/229, 9/10/70/107/229, 9/10/70/156, 9/10/70/165, 9/10/70/229, 9/10/88, 9/10/90, 9/10/96, 9/10/107, 9/10/110, 9/10/111, 9/10/112, 9/10/133, 9/10/178, 9/10/185, 9/10/186, 9/10/196, 9/10/211, 9/10/226, 11/24, 11/24/219, and 11/36/206/208, wherein the amino acid positions of the polypeptide sequence are numbered with reference to SEQ ID NO: 2. In some additional embodiments, the polynucleotide sequences encode at least one engineered carboxyesterase comprising at least one substitution or substitution set selected from: 3R/4R/6P/9C/10I/11I/36N/38Y/70W/82Q/180L/200A/214W/229M, 3R/6P/9C/10I/70W/99R, 3R/8G/9C/10I/11T/13E/70W/82Q/107F/229M, 3R/8G/9C/10I/11T/13E/70W/107F, 3R/8G/9C/10I/11T/70W, 3R/8G/9C/10I/11T/70W/229M, 3R/8G/9C/10I/13E/70W/82Q/107F, 3R/8G/9C/10I/13E/70W/82Q/229M, 3R/8G/9C/10I/70W/82Q, 3R/8G/9C/10I/70W/82Q/229M, 3R/8G/9C/10I/70W/229M, 3R/9C/10I/11I/13E/82Q, 3R/9C/10I/11T/70W/82Q/107F, 3R/9C/10I/11T/70W/229M, 3R/9C/10I/70W/82Q, 3R/9C/11I, 3R/9C/11I/70W/82Q/180L, 4R/6P/8G/9C/10I/11T/38Y/70W/82Q/180L/186F/200A/214W/229M, 4R/6P/9C/10I/11I/36N/70W/82Q/180L/200A/214W/229M, 4R/6P/9C/10I/11I/38Y/70W/82Q/180L/186F/200A/214W, 4R/6P/9C/10I/70W/82Q/229M, 4R/8G/9C/10I/11T/13E/70W/82Q/107F/229M, 4R/8G/9C/10I/11T/36N/38Y/70W/82Q/180L/200A/214W/229M, 4R/8G/9C/10I/11T/36N/70W/82Q/180L/186F/200A/214W/229M, 4R/8G/9C/10I/11T/70W/82Q/180L/200A/214W/229M, 4R/8G/9C/10I/36N/38Y/70W/82Q/180L/200A/214W/229M, 4R/9C/10I/11I/36N/38Y/70W/82Q/180L/200A/214W/229M, 4R/9C/10I/11T/36N/65I/70W/82Q/180L/186F/200A/214W, 4R/9C/10I/11T/36N/70W/82Q/180L/200A/214W, 4R/9C/10I/11T/36N/70W/82Q/180L/200A/214W/229M, 4R/9C/10I/11T/70W/82Q/180L/200A/214W, 6P/8G/9C/10I/38Y/70W/82Q/180L/200A/214W, 6P/9C/10I/11T/36N/70W/82Q/180L/200A/214W/229M, 6P/9C/10I/38Y/70W/82Q/180L/186F/200A/214W/229M, 6P/9C/10I/70W/82Q/180L/186F/200A/214W/229M, 8A/9C/10I, 8G/9C/10I/11T/13E/70W, 8G/9C/10I/11T/13E/70W/82Q, 8G/9C/10I/11T/13E/70W/82Q/107F/229M, 8G/9C/10I/11T/36N/38Y/70W/82Q/180L/200A/214W, 8G/9C/10I/11T/38Y/70W/82Q/180L/200A/214W/229M, 8G/9C/10I/11T/43I/70W/82Q/180L/200A/214W, 8G/9C/10I/11T/70W, 8G/9C/10I/11T/70W/82Q/107F/229M, 8G/9C/10I/11T/70W/229M, 8G/9C/10I/70W, 8G/9C/10I/70W/82Q/229M, 9A/10I/70W/82Q/180L/200A/214W, 9C/10I, 9C/10I/11E/12P/51D/70W/73M/110M/148L/180L, 9C/10I/11E/17C/70W/82Q/148L/180L/219H, 9C/10I/11E/17H/51D/54S/70W/82Q/180L, 9C/10I/11E/17H/70W/73M/82Q/87P/180L/219H, 9C/10I/11E/17V/49S/70W/82Q/180L/200H, 9C/10I/11E/49S/51D/54S/70W/82A/110M/148L/180L, 9C/10I/11E/49S/51D/54S/70W/82Q/87P/108H/110M/148L/180L/219H, 9C/10I/11E/49S/51D/54S/70W/82Q/87P/108H/180L, 9C/10I/11E/49S/51D/70W/82Q/108H/110M/148L/180L, 9C/10I/11E/49S/54S/70W/82Q/87P/148L/180L, 9C/10I/11E/49S/70W/82Q/87P/108H/110M/180L/200H, 9C/10I/11E/49S/70W/82Q/87P/180L, 9C/10I/11E/49S/70W/82Q/110M/148L/180L/225S, 9C/10I/11E/51D/54S/70W/82Q/148L/180L, 9C/10I/11E/54S/70W/82Q/87P/180L/192M, 9C/10I/11E/54S/70W/82Q/148L/180L/200H, 9C/10I/11E/70W/73L/82Q/108H/148L/180L, 9C/10I/11E/70W/73L/82Q/148L/180L, 9C/10I/11E/70W/73M/82Q/87P/110M/180L, 9C/10I/11E/70W/73M/82Q/148L/180L, 9C/10I/11E/70W/73M/82Q/148L/180L/192M/200H, 9C/10I/11E/70W/82Q/87P/110M/180L/219H, 9C/10I/11E/70W/82Q/148L/180L, 9C/10I/11E/70W/82Q/180L, 9C/10I/11E/70W/82Q/180L/200A/214W, 9C/10I/11G/17C/49S/70W/82Q/180L/219H, 9C/10I/11G/17V/51D/54S/70W/82Q/148L/180L/200H, 9C/10I/11G/51D/54S/70W/73L/82Q/108H/110M/180L, 9C/10I/11G/51D/70W/82Q/110M/180L/192M/219H, 9C/10I/11G/54S/70W/82Q/87P/108H/180L, 9C/10I/11G/70W/82Q/180L/200A/214W, 9C/10I/11I/35G/70W/82Q/180L/200A/214W, 9C/10I/11I/35Q/70W/82Q/180L/200A/214W, 9C/10I/11I/35S/70W/82Q/180L/200A/214W, 9C/10I/11I/36I/70W/82Q/180L/200A/214W, 9C/10I/11I/36N/38Y/65I/70W/82Q/180L/200A/214W/229M, 9C/10I/11I/36N/38Y/70W/82Q/180L/200A/214W, 9C/10I/11I/36N/38Y/70W/82Q/180L/200A/214W/229M, 9C/10I/11I/36N/70W/82Q/180L/196E/214W, 9C/10I/11I/36S/70W/82Q/180L/200A/214W, 9C/10I/11I/40V/70W/82Q/180L/200A/214W, 9C/10I/11I/54D/70W/82Q/180L/200A/214W, 9C/10I/11I/54P/70W/82Q/180L/200A/214W, 9C/10I/11I/54S/70W/82Q/180L/200A/214W, 9C/10I/11I/70V/82Q/180L/200A/214W, 9C/10I/11I/70W, 9C/10I/11I/70W/71H/82Q/180L/200A/214W, 9C/10I/11I/70W/71R/82Q/180L/200A/214W, 9C/10I/11I/70W/73L/82Q/180L/200A/214W, 9C/10I/11I/70W/73M/82Q/180L/200A/214W, 9C/10I/11I/70W/73R/82Q/180L/200A/214W, 9C/10I/11I/70W/82A/180L/200A/214W, 9C/10I/11I/70W/82Q/100S/180L/200A/214W, 9C/10I/11I/70W/82Q/108R/180L/200A/214W, 9C/10I/11I/70W/82Q/148L/180L/200A/214W, 9C/10I/11I/70W/82Q/180L/200A/214W, 9C/10I/11I/70W/87V/180L/200A/214W, 9C/10I/11T/36N/38Y/70W/82Q/180L/200A/214W/229M, 9C/10I/11T/36N/70W/82Q/180L/200A/214W/229M, 9C/10I/11T/38Y/70W/82Q/180L/186F/200A/214W, 9C/10I/11T/70W, 9C/10I/11T/70W/82Q, 9C/10I/11T/70W/82Q/107F, 9C/10I/11T/70W/107F, 9C/10I/12P/49S/51D/54S/70W/82Q/108H/148L/180L/225S, 9C/10I/12P/51D/70W/73L/82Q/148L/180L/200H, 9C/10I/12P/70W/82Q/180L/200A/214W, 9C/10I/12V/70W/82Q/180L/200A/214W, 9C/10I/13E/70W, 9C/10I/13E/70W/82Q, 9C/10I/13E/70W/229M, 9C/10I/13E/207Q, 9C/10I/17A/70W/82Q/180L/200A/214W, 9C/10I/17C/51D/54S/70W/82Q/87P/108H/110M/180L/200H, 9C/10I/17C/70W/73L/82Q/108H/110M/148L/180L/200H, 9C/10I/17C/70W/82Q/87P/148L/180L/192M/219H, 9C/10I/17C/70W/82Q/180L/200A/214W, 9C/10I/17H/49S/51D/54S/70W/73M/82Q/108H/110M/148L/180L/192M/200H/219H, 9C/10I/17H/54S/70W/82Q/87P/108H/110M/180L, 9C/10I/17H/70W/82Q/110M/148L/180L, 9C/10I/17H/70W/82Q/180L/200A/214W, 9C/10I/17Q/70W/82Q/180L/200A/214W, 9C/10I/17S/70W/82Q/180L/200A/214W, 9C/10I/17V/49S/51D/54S/70W/82Q/87P/180L/219H, 9C/10I/17V/49S/70W/82Q/148L/180L, 9C/10I/17V/51D/70W/73M/82Q/87P/108H/110M/148L/180L/219H, 9C/10I/17V/54S/70W/73L/

82Q/87P/108H/110M/148L/180L/200H, 9C/10I/17V/54S/70W/73L/82Q/108H/110M/148L/180L, 9C/10I/17V/70W/73M/82Q/87P/180L/219H, 9C/10I/17V/70W/82Q/87P/148L/180L, 9C/10I/17V/70W/82Q/108H/148L/180L, 9C/10I/17V/70W/82Q/110M/148L/180L/200H, 9C/10I/17V/70W/82Q/180L/200A/214W, 9C/10I/17V/70W/104M/160E/165Q, 9C/10I/17V/70W/139H/160G/165Q, 9C/10I/17W, 9C/10I/26G, 9C/10I/26T, 9C/10I/29G/70W, 9C/10I/36N/70W/82Q/180L/200A/214W, 9C/10I/37P, 9C/10I/38Y/70W/82Q/180L/200A/214W, 9C/10I/39A/186T, 9C/10I/39W, 9C/10I/41F, 9C/10I/41G, 9C/10I/41S, 9C/10I/45R/70W, 9C/10I/45T/70W, 9C/10I/49S/51D/54S/70W/73M/82Q/148L/180L, 9C/10I/49S/51D/54S/70W/82G/108H/110M/148L/180L/225S, 9C/10I/49S/51D/54S/70W/82Q/110M/148L/180L, 9C/10I/49S/51D/54S/70W/82Q/110M/180L, 9C/10I/49S/51D/54S/70W/82Q/148L/180L, 9C/10I/49S/51D/54S/70W/82Q/148L/180L/192M, 9C/10I/49S/51D/70W/82Q/108H/148L/180L/219H, 9C/10I/49S/51D/70W/82Q/110M/148L/180L, 9C/10I/49S/51D/70W/82Q/180L/225S, 9C/10I/49S/54S/70W/73L/82Q/87P/110M/180L, 9C/10I/49S/54S/70W/82Q/87P/110M/180L, 9C/10I/49S/54S/70W/82Q/108H/148L/180L/225S, 9C/10I/49S/70W/73L/82G/108H/110M/148L/180L/225S, 9C/10I/49S/70W/73L/82Q/87P/108H/148L/180L, 9C/10I/49S/70W/82Q/87P/148L/180L, 9C/10I/49S/70W/82Q/110M/180L/219H, 9C/10I/51D/54S/70W/73L/82Q/108H/180L, 9C/10I/51D/54S/70W/73L/82Q/110M/148L/180L, 9C/10I/51D/54S/70W/73M/82Q/110M/180L, 9C/10I/51D/54S/70W/73M/82Q/180L/219H, 9C/10I/51D/54S/70W/73M/82Q/180L/225S, 9C/10I/51D/54S/70W/82Q/87P/180L, 9C/10I/51D/54S/70W/82Q/148L/180L, 9C/10I/51D/54S/70W/82Q/180L, 9C/10I/51D/54S/70W/82Q/180L/200H, 9C/10I/51D/70W/82Q/108H/180L, 9C/10I/51D/70W/82Q/110M/180L/200H, 9C/10I/51D/70W/82Q/180L/219H, 9C/10I/54S/70W/73M/82Q/108H/148L/180L/192M, 9C/10I/54S/70W/82G/180L, 9C/10I/54S/70W/82Q/87P/108H/180L/200H, 9C/10I/54S/70W/82Q/180L, 9C/10I/62G, 9C/10I/70R, 9C/10I/70W, 9C/10I/70W/73L/82Q/87P/108H/110M/180L, 9C/10I/70W/73L/82Q/108H/148L/180L, 9C/10I/70W/73L/82Q/108H/148L/180L/192M, 9C/10I/70W/73L/82Q/108H/180L, 9C/10I/70W/73L/82Q/148L/180L/200H, 9C/10I/70W/73L/82Q/180L/192M, 9C/10I/70W/73L/82Q/180L/192M/219H, 9C/10I/70W/73M/82Q/87P/180L/192M/219H, 9C/10I/70W/73M/82Q/87P/180L/200H, 9C/10I/70W/73M/82Q/108H/110M/180L/200H/219H, 9C/10I/70W/73M/82Q/108H/148L/180L, 9C/10I/70W/73M/82Q/108H/148L/180L/192M/219H, 9C/10I/70W/73M/82Q/148L/180L, 9C/10I/70W/82Q, 9C/10I/70W/82Q/87P/108H/110M/148L/180L/192M/219H, 9C/10I/70W/82Q/87P/108H/110M/180L, 9C/10I/70W/82Q/87P/108H/110M/180L/192M, 9C/10I/70W/82Q/87P/180L, 9C/10I/70W/82Q/107F, 9C/10I/70W/82Q/107F/229M, 9C/10I/70W/82Q/108H/110M/180L/219H, 9C/10I/70W/82Q/108H/180L, 9C/10I/70W/82Q/110M/148L/180L, 9C/10I/70W/82Q/110M/180L/219H, 9C/10I/70W/82Q/148L/180L, 9C/10I/70W/82Q/148L/180L/200H, 9C/10I/70W/82Q/148L/180L/200H/219H, 9C/10I/70W/82Q/180L, 9C/10I/70W/82Q/180L/192M/219H, 9C/10I/70W/82Q/180L/200A/214W, 9C/10I/70W/82Q/229M, 9C/10I/70W/92R, 9C/10I/70W/99R, 9C/10I/70W/99R/229M, 9C/10I/70W/107F/229M, 9C/10I/70W/156E, 9C/10I/70W/165Q, 9C/10I/70W/229M, 9C/10I/88G, 9C/10I/90S, 9C/10I/96F, 9C/10I/107F, 9C/10I/110V, 9C/10I/111M, 9C/10I/112G, 9C/10I/133E, 9C/10I/133W, 9C/10I/178E, 9C/10I/185E, 9C/10I/186Q, 9C/10I/196Q, 9C/10I/196R, 9C/10I/196S, 9C/10I/211E, 9C/10I/226E, 9C/10I/226W, 9R/10I/11E/12P/51D/54S/70W/73L/82Q/110M/180L, 9R/10I/11E/12P/51D/70W/73M/82Q/148L/180L/200H/225S, 9R/10I/11E/12S/51D/54S/70W/73M/82Q/148L/180L/225S, 9R/10I/54S/70W/82Q/180L, 9R/10I/70W/82Q/180L/200A/214W, 9T/10I/11E/12N/49S/70W/73M/82Q/180L, 9T/10/11E/12P/51D/70W/73L/82Q/148L/180L, 9T/10I/11G/12S/49S/51D/70W/73M/82Q/180L/200H/225S, 9T/10I/11G/51D/54S/70W/73L/82Q/108H/180L/200H/225S, 9T/10I/11G/51D/54S/70W/73L/82Q/110M/148L/180L, 9T/10I/11R/12P/51D/54S/70W/73L/82Q/108H/148L/180L/225S, 9T/10I/12P/70W/82A/148L/180L/225S, 9T/10I/12S/51D/54S/70W/180L/225S, 9T/10I/49S/51D/54S/70W/73M/82Q/108H/110M/148L/180L/192M, 9T/10I/70W/73L/82Q/108H/110M/148L/180L, 11L/24T, 11L/24T/219D, and 11L/36S/206F/208A, wherein the amino acid positions are numbered with reference to SEQ ID NO: 2. In some further embodiments, the polynucleotide sequences encode at least one engineered carboxyesterase comprising at least one substitution or substitution set selected from: S3R/P4R/T6P/W9C/M10I/M11I/D36N/S38Y/N70W/V82Q/P180L/T200A/V214W/T229M, S3R/T6P/W9C/M10I/N70W/V99R, S3R/R8G/W9C/M10I/M11T/D13E/N70W/V82Q/A107F/T229M, S3R/R8G/W9C/M10I/M11T/D13E/N70W/A107F, S3R/R8G/W9C/M10I/M11T/N70W, S3R/R8G/W9C/M10I/M11T/N70W/T229M, S3R/R8G/W9C/M10I/D13E/N70W/V82Q/A107F, S3R/R8G/W9C/M10I/D13E/N70W/V82Q/T229M, S3R/R8G/W9C/M10I/N70W/V82Q, S3R/R8G/W9C/M10I/N70W/V82Q/T229M, S3R/R8G/W9C/M10I/N70W/T229M, S3R/W9C/M10I/M11I/D13E/V82Q, S3R/W9C/M10I/M11T/N70W/V82Q/A107F, S3R/W9C/M10I/M11T/N70W/T229M, S3R/W9C/M10I/N70W/V82Q, S3R/W9C/M11I, S3R/W9C/M11I/N70W/V82Q/P180L, P4R/T6P/R8G/W9C/M10I/M11T/S38Y/N70W/V82Q/P180L/A186F/T200A/V214W/T229M, P4R/T6P/W9C/M10I/M11I/D36N/N70W/V82Q/P180L/T200A/V214W/T229M, P4R/T6P/W9C/M10I/M11I/S38Y/N70W/V82Q/P180L/A186F/T200A/V214W, P4R/T6P/W9C/M10I/N70W/V82Q/T229M, P4R/R8G/W9C/M10I/M11T/D13E/N70W/V82Q/A107F/T229M, P4R/R8G/W9C/M10I/M11T/D36N/S38Y/N70W/V82Q/P180L/T200A/V214W/T229M, P4R/R8G/W9C/M10I/M11T/D36N/N70W/V82Q/P180L/A186F/T200A/V214W/T229M, P4R/R8G/W9C/M10I/M11T/N70W/V82Q/P180L/T200A/V214W/T229M, P4R/R8G/W9C/M10I/D36N/S38Y/N70W/V82Q/P180L/T200A/V214W/T229M, P4R/W9C/M10I/M11I/D36N/S38Y/N70W/V82Q/P180L/T200A/V214W/T229M, P4R/W9C/M10I/M11T/D36N/R65I/N70W/V82Q/P180L/A186F/T200A/V214W, P4R/W9C/M10I/M11T/D36N/N70W/V82Q/P180L/T200A/V214W, P4R/W9C/M10I/M11T/D36N/N70W/V82Q/P180L/T200A/V214W/T229M, P4R/W9C/M10I/M11T/N70W/V82Q/P180L/T200A/V214W, T6P/R8G/W9C/M10I/S38Y/N70W/V82Q/P180L/T200A/V214W, T6P/W9C/M10I/M11T/D36N/N70W/V82Q/P180L/T200A/V214W/T229M, T6P/W9C/M10I/S38Y/N70W/V82Q/P180L/A186F/T200A/V214W/T229M, T6P/W9C/M10I/N70W/V82Q/P180L/A186F/T200A/V214W/T229M, R8A/W9C/M10I, R8G/W9C/M10I/M11T/D13E/N70W, R8G/W9C/M10I/M11T/D13E/N70W/V82Q, R8G/W9C/M10I/M11T/D13E/N70W/V82Q/A107F/T229M, R8G/W9C/M10I/M11T/D36N/S38Y/N70W/V82Q/P180L/T200A/V214W, R8G/W9C/M10I/M11T/S38Y/N70W/V82Q/P180L/T200A/V214W/T229M, R8G/W9C/M10I/M11T/M43I/N70W/V82Q/P180L/T200A/V214W, R8G/W9C/M10I/M11T/N70W, R8G/W9C/M10I/M11T/N70W/V82Q/A107F/T229M, R8G/W9C/M10I/M11T/N70W/T229M, R8G/W9C/M10I/N70W, R8G/W9C/M10I/N70W/V82Q/T229M, W9A/M10I/N70W/V82Q/P180L/T200A/V214W, W9C/M10I, W9C/

M10I/M1E/L12P/Q51D/N70W/V73M/Q110M/M148L/P180L, W9C/M10I/M11E/R17C/N70W/V82Q/M148L/P180L/A219H, W9C/M10I/M11E/R17H/Q51D/A54S/N70W/V82Q/P180L, W9C/M10I/M11E/R17H/N70W/V73M/V82Q/A87P/P180L/A219H, W9C/M10I/M11E/R17V/R49S/N70W/V82Q/P180L/T200H, W9C/M10I/M11E/R49S/Q51D/A54S/N70W/V82A/Q10M/M148L/P180L, W9C/M10I/M11E/R49S/Q51D/A54S/N70W/V82Q/A87P/N108H/Q10M/M148L/P180L/A219H, W9C/M10I/M11E/R49S/Q51D/A54S/N70W/V82Q/A87P/N108H/P180L, W9C/M10I/M11E/R49S/Q51D/N70W/V82Q/N108H/Q110M/M148L/P180L, W9C/M10I/M11E/R49S/A54S/N70W/V82Q/A87P/M148L/P180L, W9C/M10I/M11E/R49S/N70W/V82Q/A87P/N108H/Q110M/P180L/T200H, W9C/M10I/M11E/R49S/N70W/V82Q/A87P/P180L, W9C/M10I/M11E/R49S/N70W/V82Q/Q10M/M148L/P180L/Q225S, W9C/M10I/M11E/Q51D/A54S/N70W/V82Q/M148L/P180L, W9C/M10I/M11E/A54S/N70W/V82Q/A87P/P180L/Q192M, W9C/M10I/M11E/A54S/N70W/V82Q/M148L/P180L/T200H, W9C/M10I/M11E/N70W/V73L/V82Q/N108H/M148L/P180L, W9C/M10I/M11E/N70W/V73L/V82Q/M148L/P180L, W9C/M10I/M11E/N70W/V73M/V82Q/A87P/Q110M/P180L, W9C/M10I/M11E/N70W/V73M/V82Q/M148L/P180L, W9C/M10I/M11E/N70W/V73M/V82Q/M148L/P180L/Q192M/T200H, W9C/M10I/M11E/N70W/V82Q/A87P/Q110M/P180L/A219H, W9C/M10I/M11E/N70W/V82Q/M148L/P180L, W9C/M11/M11E/N70W/V82Q/P180L, W9C/M10I/M11E/N70W/V82Q/P180L/T200A/V214W, W9C/M10I/M11G/R17C/R49S/N70W/V82Q/P180L/A219H, W9C/M10I/M11G/R17V/Q51D/A54S/N70W/V82Q/M148L/P180L/T200H, W9C/M10I/M11G/Q51D/A54S/N70W/V73L/V82Q/N108H/Q110M/P180L, W9C/M10I/M11G/Q51D/N70W/V82Q/Q110M/P180L/Q192M/A219H, W9C/M10I/M11G/A54S/N70W/V82Q/A87P/N108H/P180L, W9C/M10I/M11G/N70W/V82Q/P180L/T200A/V214W, W9C/M10I/M11I/A35G/N70W/V82Q/P180L/T200A/V214W, W9C/M10I/M11I/A35Q/N70W/V82Q/P180L/T200A/V214W, W9C/M10I/M11I/A35S/N70W/V82Q/P180L/T200A/V214W, W9C/M10I/M11I/D36I/N70W/V82Q/P180L/T200A/V214W, W9C/M10I/M11I/D36N/S38Y/R65I/N70W/V82Q/P180L/T200A/V214W/T229M, W9C/M10I/M11I/D36N/S38Y/N70W/V82Q/P180L/T200A/V214W, W9C/M10I/M11I/D36N/S38Y/N70W/V82Q/P180L/T200A/V214W/T229M, W9C/M10I/M11I/D36N/N70W/V82Q/P180L/A196E/V214W, W9C/M10I/M11I/D36S/N70W/V82Q/P180L/T200A/V214W, W9C/M10I/M11I/F40V/N70W/V82Q/P180L/T200A/V214W, W9C/M10I/M11I/A54D/N70W/V82Q/P180L/T200A/V214W, W9C/M10I/M11I/A54P/N70W/V82Q/P180L/T200A/V214W, W9C/M10I/M11I/A54S/N70W/V82Q/P180L/T200A/V214W, W9C/M10I/M11I/N70V/V82Q/P180L/T200A/V214W, W9C/M10I/M11I/N70W, W9C/M10I/M11I/N70W/N71H/V82Q/P180L/T200A/V214W, W9C/M10I/M11I/N70W/N71R/V82Q/P180L/T200A/V214W, W9C/M10I/M11I/N70W/V73L/V82Q/P180L/T200A/V214W, W9C/M10I/M11I/N70W/V73M/V82Q/P180L/T200A/V214W, W9C/M10I/M11I/N70W/V73R/V82Q/P180L/T200A/V214W, W9C/M10I/M11I/N70W/V82A/P180L/T200A/V214W, W9C/M10I/M11I/N70W/V82Q/A100S/P180L/T200A/V214W, W9C/M10I/M11I/N70W/V82Q/N108R/P180L/T200A/V214W, W9C/M10I/M11I/N70W/V82Q/M148L/P180L/T200A/V214W, W9C/M10I/M11I/N70W/V82Q/P180L/T200A/V214W, W9C/M10I/M11I/N70W/A87V/P180L/T200A/V214W, W9C/M10I/M11T/D36N/S38Y/N70W/V82Q/P180L/T200A/V214W/T229M, W9C/M10I/M11T/D36N/N70W/V82Q/P180L/T200A/V214W/T229M, W9C/M10I/M11T/S38Y/N70W/V82Q/P180L/A186F/T200A/V214W, W9C/M10I/M11T/N70W, W9C/M10I/M11T/N70W/V82Q, W9C/M10I/M11T/N70W/V82Q/A107F, W9C/M10I/M1 IT/N70W/A107F, W9C/M10I/L12P/R49S/Q51D/A54S/N70W/V82Q/N108H/M148L/P180L/Q225S, W9C/M10I/L12P/Q51D/N70W/V73L/V82Q/M148L/P180L/T200H, W9C/M10I/L12P/N70W/V82Q/P180L/T200A/V214W, W9C/M10I/L12V/N70W/V82Q/P180L/T200A/V214W, W9C/M10I/D13E/N70W, W9C/M10I/D13E/N70W/V82Q, W9C/M10I/D13E/N70W/T229M, W9C/M10I/D13E/P207Q, W9C/M10I/R17A/N70W/V82Q/P180L/T200A/V214W, W9C/M10I/R17C/Q51D/A54S/N70W/V82Q/A87P/N108H/Q110M/P180L/T200H, W9C/M10I/R17C/N70W/V73L/V82Q/N108H/Q110M/M148L/P180L/T200H, W9C/M10I/R17C/N70W/V82Q/A87P/M148L/P180L/Q192M/A219H, W9C/M10I/R17C/N70W/V82Q/P180L/T200A/V214W, W9C/M10I/R17H/R49S/Q51D/A54S/N70W/V73M/V82Q/N108H/Q110M/M148L/P180L/Q192M/T 200H/A219H, W9C/M10I/R17H/A54S/N70W/V82Q/A87P/N108H/Q110M/P180L, W9C/M10I/R17H/N70W/V82Q/Q110M/M148L/P180L, W9C/M10I/R17H/N70W/V82Q/P180L/T200A/V214W, W9C/M10I/R17Q/N70W/V82Q/P180L/T200A/V214W, W9C/M10I/R17S/N70W/V82Q/P180L/T200A/V214W, W9C/M10I/R17V/R49S/Q51D/A54S/N70W/V82Q/A87P/P180L/A219H, W9C/M10I/R17V/R49S/N70W/V82Q/M148L/P180L, W9C/M10I/R17V/Q51D/N70W/V73M/V82Q/A87P/N108H/Q110M/M148L/P180L/A219H, W9C/M10I/R17V/A54S/N70W/V73L/V82Q/A87P/N108H/Q110M/M148L/P180L/T200H, W9C/M10I/R17V/A54S/N70W/V73L/V82Q/N108H/Q110M/M148L/P180L, W9C/M10I/R17V/N70W/V73M/V82Q/A87P/P180L/A219H, W9C/M10I/R17V/N70W/V82Q/A87P/M148L/P180L, W9C/M10I/R17V/N70W/V82Q/N108H/M148L/P180L, W9C/M10I/R17V/N70W/V82Q/Q110M/M148L/P180L/T200H, W9C/M10I/R17V/N70W/V82Q/P180L/T200A/V214W, W9C/M10I/R17V/N70W/A104M/S160E/G165Q, W9C/M10I/R17V/N70W/R139H/S160G/G165Q, W9C/M10I/R17W, W9C/M10I/A26G, W9C/M10I/A26T, W9C/M10I/W29G/N70W, W9C/M10I/D36N/N70W/V82Q/P180L/T200A/V214W, W9C/M10I/G37P, W9C/M10I/S38Y/N70W/V82Q/P180L/T200A/V214W, W9C/M10I/D39A/A186T, W9C/M10I/D39W, W9C/M10I/A41F, W9C/M10I/A41G, W9C/M10I/A41S, W9C/M10I/P45R/N70W, W9C/M10I/P45T/N70W, W9C/M10I/R49S/Q51D/A54S/N70W/V73M/V82Q/M148L/P180L, W9C/M10I/R49S/Q51D/A54S/N70W/V82G/N108H/Q110M/M148L/P180L/Q225S, W9C/M10I/R49S/Q51D/A54S/N70W/V82Q/Q110M/M148L/P180L, W9C/M10I/R49S/Q51D/A54S/N70W/V82Q/Q110M/P180L, W9C/M10I/R49S/Q51D/A54S/N70W/V82Q/M148L/P180L, W9C/M10I/R49S/Q51D/A54S/N70W/V82Q/M148L/P180L/Q192M, W9C/M10I/R49S/Q51D/N70W/V82Q/N108H/M148L/P180L/A219H, W9C/M10I/R49S/Q51D/N70W/V82Q/Q110M/M148L/P180L, W9C/M10I/R49S/Q51D/N70W/V82Q/P180L/Q225S, W9C/M10I/R49S/A54S/N70W/V73L/V82Q/A87P/Q110M/P180L, W9C/M10I/R49S/A54S/N70W/V82Q/A87P/Q110M/P180L, W9C/M10I/R49S/A54S/N70W/V82Q/N108H/M148L/P180L/Q225S, W9C/M10I/R49S/N70W/V73L/V82G/N108H/Q110M/M148L/P180L/Q225S, W9C/M10I/R49S/N70W/V73L/V82Q/A87P/N108H/M148L/P180L, W9C/M10I/R49S/N70W/V82Q/A87P/M148L/P180L, W9C/M10I/R49S/N70W/V82Q/Q110M/P180L/A219H, W9C/M10I/Q51D/A54S/N70W/V73L/V82Q/N108H/P180L, W9C/M10I/Q51D/A54S/N70W/V73L/V82Q/Q110M/M148L/P180L, W9C/

M10I/Q51D/A54S/N70W/V73M/V82Q/Q110M/P180L, W9C/M10I/Q51D/A54S/N70W/V73M/V82Q/P180L/A219H, W9C/M10I/Q51D/A54S/N70W/V73M/V82Q/P180L/Q225S, W9C/M10I/Q51D/A54S/N70W/V82Q/A87P/P180L, W9C/M10I/Q51D/A54S/N70W/V82Q/M148L/P180L, W9C/M10I/Q51D/A54S/N70W/V82Q/P180L, W9C/M10I/Q51D/A54S/N70W/V82Q/P180L/T200H, W9C/M10I/Q51D/N70W/V82Q/N108H/P180L, W9C/M10I/Q51D/N70W/V82Q/Q110M/P180L/T200H, W9C/M10I/Q51D/N70W/V82Q/P180L/A219H, W9C/M10I/A54S/N70W/V73M/V82Q/N108H/M148L/P180L/Q192M, W9C/M10I/A54S/N70W/V82G/P180L, W9C/M10I/A54S/N70W/V82Q/A87P/N108H/P180L/T200H, W9C/M10I/A54S/N70W/V82Q/P180L, W9C/M10I/A62G, W9C/M10I/N70R, W9C/M10I/N70W, W9C/M10I/N70W/V73L/V82Q/A87P/N108H/Q110M/P180L, W9C/M10I/N70W/V73L/V82Q/N108H/M148L/P180L, W9C/M10I/N70W/V73L/V82Q/N108H/M148L/P180L/Q192M, W9C/M10I/N70W/V73L/V82Q/N108H/P180L, W9C/M10I/N70W/V73L/V82Q/M148L/P180L/T200H, W9C/M10I/N70W/V73L/V82Q/P180L/Q192M, W9C/M10I/N70W/V73L/V82Q/P180L/Q192M/A219H, W9C/M10I/N70W/V73M/V82Q/A87P/P180L/Q192M/A219H, W9C/M10I/N70W/V73M/V82Q/A87P/P180L/T200H, W9C/M10I/N70W/V73M/V82Q/N108H/Q110M/P180L/T200H/A219H, W9C/M10I/N70W/V73M/V82Q/N108H/M148L/P180L, W9C/M10I/N70W/V73M/V82Q/N108H/M148L/P180L/Q192M/A219H, W9C/M10I/N70W/V73M/V82Q/M148L/P180L, W9C/M10I/N70W/V82Q, W9C/M10I/N70W/V82Q/A87P/N108H/Q110M/M148L/P180L/Q192M/A219H, W9C/M10I/N70W/V82Q/A87P/N108H/Q110M/P180L, W9C/M10I/N70W/V82Q/A87P/N108H/Q110M/P180L/Q192M, W9C/M10I/N70W/V82Q/A87P/P180L, W9C/M10I/N70W/V82Q/A107F, W9C/M10I/N70W/V82Q/A107F/T229M, W9C/M10I/N70W/V82Q/N108H/Q110M/P180L/A219H, W9C/M10I/N70W/V82Q/N108H/P180L, W9C/M10I/N70W/V82Q/Q110M/M148L/P180L, W9C/M10I/N70W/V82Q/Q110M/P180L/A219H, W9C/M10I/N70W/V82Q/M148L/P180L, W9C/M10I/N70W/V82Q/M148L/P180L/T200H, W9C/M10I/N70W/V82Q/M148L/P180L/T200H/A219H, W9C/M10I/N70W/V82Q/P180L, W9C/M10I/N70W/V82Q/P180L/Q192M/A219H, W9C/M10I/N70W/V82Q/P180L/T200A/V214W, W9C/M10I/N70W/V82Q/T229M, W9C/M10I/N70W/K92R, W9C/M10I/N70W/V99R, W9C/M10I/N70W/V99R/T229M, W9C/M10I/N70W/A107F/T229M, W9C/M10I/N70W/A156E, W9C/M10I/N70W/G165Q, W9C/M10I/N70W/T229M, W9C/M10I/Q88G, W9C/M10I/A90S, W9C/M10I/A96F, W9C/M10I/A107F, W9C/M10I/Q110V, W9C/M10I/A111M, W9C/M10I/R112G, W9C/M10I/A133E, W9C/M10I/A133W, W9C/M10I/A178E, W9C/M10I/R185E, W9C/M10I/A186Q, W9C/M10I/A196Q, W9C/M10I/A196R, W9C/M10I/A196S, W9C/M10I/Q211E, W9C/M10I/A226E, W9C/M10I/A226W, W9R/M10I/M11E/L12P/Q51D/A54S/N70W/V73L/V82Q/Q110M/P180L, W9R/M10I/M11E/L12P/Q51D/N70W/V73M/V82Q/M148L/P180L/T200H/Q225S, W9R/M10I/M11E/L12S/Q51D/A54S/N70W/V73M/V82Q/M148L/P180L/Q225S, W9R/M10I/A54S/N70W/V82Q/P180L, W9R/M10I/N70W/V82Q/P180L/T200A/V214W, W9T/M10I/M11E/L12N/R49S/N70W/V73M/V82Q/P180L, W9T/M10I/M11E/L12P/Q51D/N70W/V73L/V82Q/M148L/P180L, W9T/M10I/M11G/L12S/R49S/Q51D/N70W/V73M/V82Q/P180L/T200H/Q225S, W9T/M10I/M11G/Q51D/A54S/N70W/V73L/V82Q/N108H/P180L/T200H/Q225S, W9T/M10I/M11G/Q51D/A54S/N70W/V73L/V82Q/Q110M/M148L/P180L, W9T/M10I/M11R/L12P/Q51D/A54S/N70W/V73L/V82Q/N108H/M148L/P180L/Q225S, W9T/M10I/L12P/N70W/V82A/M148L/P180L/Q225S, W9T/M10I/L12S/Q51D/A54S/N70W/P180L/Q225S, W9T/M10I/R49S/Q51D/A54S/N70W/V73M/V82Q/N108H/Q110M/M148L/P180L/Q192M, W9T/M10I/N70W/V73L/V82Q/N108H/Q110M/M148L/P180L, M11L/Q24T, M11L/Q24T/A219D, and M11L/D36S/Y206F/M208A, wherein the amino acids are numbered with reference to SEQ ID NO: 2.

An isolated polynucleotide encoding an improved carboxyesterase polypeptide may be manipulated in a variety of ways to provide for expression of the polypeptide. Manipulation of the isolated polynucleotide prior to its insertion into a vector may be desirable or necessary depending on the expression vector. The techniques for modifying polynucleotides and nucleic acid sequences utilizing recombinant DNA methods are well known in the art.

For bacterial host cells, suitable promoters for directing transcription of the nucleic acid constructs of the present invention, include the promoters obtained from the *E. coli* lac operon, *Streptomyces coelicolor* agarase gene (dagA), *Bacillus subtilis* levansucrase gene (sacB), *Bacillus licheniformis* alpha-amylase gene (amyL), *Bacillus stearothermophilus* maltogenic amylase gene (amyM), *Bacillus amyloliquefaciens* alpha-amylase gene (amyQ), *Bacillus licheniformis* penicillinase gene (penP), *Bacillus subtilis* xylA and xylB genes, and prokaryotic beta-lactamase gene (See, e.g., Villa-Kamaroff et al., Proc. Natl. Acad. Sci. USA 75: 3727-3731 [1978]), as well as the tac promoter (See, e.g., DeBoer et al., Proc. Natl Acad. Sci. USA 80: 21-25 [1983]). Additional suitable promoters are known to those in the art.

For filamentous fungal host cells, suitable promoters for directing the transcription of the nucleic acid constructs of the present invention include promoters obtained from the genes for *Aspergillus oryzae* TAKA amylase, *Rhizomucor miehei* aspartic proteinase, *Aspergillus niger* neutral alpha-amylase, *Aspergillus niger* acid stable alpha-amylase, *Aspergillus niger* or *Aspergillus awamori* glucoamylase (glaA), *Rhizomucor miehei* lipase, *Aspergillus oryzae* alkaline protease, *Aspergillus oryzae* triose phosphate isomerase, *Aspergillus nidulans* acetamidase, and *Fusarium oxysporum* trypsin-like protease (WO 96/00787), as well as the NA2-tpi promoter (a hybrid of the promoters from the genes for *Aspergillus niger* neutral alpha-amylase and *Aspergillus oryzae* triose phosphate isomerase), and mutant, truncated, and hybrid promoters thereof.

In a yeast host, useful promoters include, but are not limited to those from the genes for *Saccharomyces cerevisiae* enolase (ENO-1), *Saccharomyces cerevisiae* galactokinase (GAL1), *Saccharomyces cerevisiae* alcohol dehydrogenase/glyceraldehyde-3-phosphate dehydrogenase (ADH2/GAP), and *Saccharomyces cerevisiae* 3-phosphoglycerate kinase, as well as other useful promoters for yeast host cells (See, e.g., Romanos, et al., Yeast 8:423-488 [1992]).

The control sequence may also be a suitable transcription terminator sequence, a sequence recognized by a host cell to terminate transcription. The terminator sequence is operably linked to the 3' terminus of the nucleic acid sequence encoding the polypeptide. Any terminator that is functional in the host cell of choice may be used in the present invention.

For example, exemplary transcription terminators for filamentous fungal host cells can be obtained from the genes for *Aspergillus oryzae* TAKA amylase, *Aspergillus niger* glucoamylase, *Aspergillus nidulans* anthranilate synthase, *Aspergillus niger* alpha-glucosidase, and *Fusarium oxysporum* trypsin-like protease.

Exemplary terminators for yeast host cells can be obtained from the genes for *Saccharomyces cerevisiae* enolase, *Saccharomyces cerevisiae* cytochrome C (CYC1), and *Saccharomyces cerevisiae* glyceraldehyde-3-phosphate dehydrogenase, as well as other useful terminators for yeast host cells known in the art (See, e.g., Romanos et al., supra).

The control sequence may also be a suitable leader sequence, a nontranslated region of an mRNA that is important for translation by the host cell. The leader sequence is operably linked to the 5' terminus of the nucleic acid sequence encoding the polypeptide. Any leader sequence that is functional in the host cell of choice may be used. Exemplary leaders for filamentous fungal host cells are obtained from the genes for *Aspergillus oryzae* TAKA amylase and *Aspergillus nidulans* triose phosphate isomerase. Suitable leaders for yeast host cells are obtained from the genes for *Saccharomyces cerevisiae* enolase (ENO-1), *Saccharomyces cerevisiae* 3-phosphoglycerate kinase, *Saccharomyces cerevisiae* alpha-factor, and *Saccharomyces cerevisiae* alcohol dehydrogenase/glyceraldehyde-3-phosphate dehydrogenase (ADH2/GAP).

The control sequence may also be a polyadenylation sequence, a sequence operably linked to the 3' terminus of the nucleic acid sequence and which, when transcribed, is recognized by the host cell as a signal to add polyadenosine residues to transcribed mRNA. Any polyadenylation sequence which is functional in the host cell of choice may be used in the present invention. Exemplary polyadenylation sequences for filamentous fungal host cells can be from the genes for *Aspergillus oryzae* TAKA amylase, *Aspergillus niger* glucoamylase, *Aspergillus nidulans* anthranilate synthase, *Fusarium oxysporum* trypsin-like protease, and *Aspergillus niger* alpha-glucosidase, as well as additional useful polyadenylation sequences for yeast host cells known in the art (See, e.g., Guo et al., Mol. Cell. Biol., 15:5983-5990 [1995]).

The control sequence may also be a signal peptide coding region that codes for an amino acid sequence linked to the amino terminus of a polypeptide and directs the encoded polypeptide into the cell's secretory pathway. The 5' end of the coding sequence of the nucleic acid sequence may inherently contain a signal peptide coding region naturally linked in translation reading frame with the segment of the coding region that encodes the secreted polypeptide. Alternatively, the 5' end of the coding sequence may contain a signal peptide coding region that is foreign to the coding sequence. The foreign signal peptide coding region may be required where the coding sequence does not naturally contain a signal peptide coding region.

Alternatively, the foreign signal peptide coding region may simply replace the natural signal peptide coding region in order to enhance secretion of the polypeptide. However, any signal peptide coding region which directs the expressed polypeptide into the secretory pathway of a host cell of choice may be used in the present invention.

Effective signal peptide coding regions for bacterial host cells are the signal peptide coding regions obtained from the genes for *Bacillus* NC1B 11837 maltogenic amylase, *Bacillus stearothermophilus* alpha-amylase, *Bacillus licheniformis* subtilisin, *Bacillus licheniformis* beta-lactamase, *Bacillus stearothermophilus* neutral proteases (nprT, nprS, nprM), and *Bacillus subtilis* prsA, as well as additional signal peptides known in the art (See, e.g., Simonen et al., Microbiol. Rev., 57: 109-137 [1993]).

Effective signal peptide coding regions for filamentous fungal host cells include, but are not limited to the signal peptide coding regions obtained from the genes for *Aspergillus oryzae* TAKA amylase, *Aspergillus niger* neutral amylase, *Aspergillus niger* glucoamylase, *Rhizomucor miehei* aspartic proteinase, *Humicola insolens* cellulase, and *Humicola lanuginosa* lipase. Useful signal peptides for yeast host cells can be from the genes for *Saccharomyces cerevisiae* alpha-factor and *Saccharomyces cerevisiae* invertase, as well as additional useful signal peptide coding regions (See, e.g., Romanos et al., 1992, supra).

The control sequence may also be a propeptide coding region that codes for an amino acid sequence positioned at the amino terminus of a polypeptide. The resultant polypeptide is known as a proenzyme or propolypeptide (or a zymogen in some cases). A propolypeptide is generally inactive and can be converted to a mature active polypeptide by catalytic or autocatalytic cleavage of the propeptide from the propolypeptide. The propeptide coding region may be obtained from the genes for *Bacillus subtilis* alkaline protease (aprE), *Bacillus subtilis* neutral protease (nprT), *Saccharomyces cerevisiae* alpha-factor, *Rhizomucor miehei* aspartic proteinase, and *Myceliophthora thermophila* lactase (WO 95/33836).

Where both signal peptide and propeptide regions are present at the amino terminus of a polypeptide, the propeptide region is positioned next to the amino terminus of a polypeptide and the signal peptide region is positioned next to the amino terminus of the propeptide region.

It may also be desirable to add regulatory sequences, which allow the regulation of the expression of the polypeptide relative to the growth of the host cell. Examples of regulatory systems are those which cause the expression of the gene to be turned on or off in response to a chemical or physical stimulus, including the presence of a regulatory compound. In prokaryotic host cells, suitable regulatory sequences include the lac, tac, and trp operator systems. In yeast host cells, suitable regulatory systems include, as examples, the ADH2 system or GAL1 system. In filamentous fungi, suitable regulatory sequences include the TAKA alpha-amylase promoter, *Aspergillus niger* glucoamylase promoter, and *Aspergillus oryzae* glucoamylase promoter.

Other examples of regulatory sequences are those which allow for gene amplification. In eukaryotic systems, these include the dihydrofolate reductase gene, which is amplified in the presence of methotrexate, and the metallothionein genes, which are amplified with heavy metals. In these cases, the nucleic acid sequence encoding the carboxyesterase polypeptide of the present invention would be operably linked with the regulatory sequence.

Thus, in some embodiments, the present invention is also directed to a recombinant expression vector comprising a polynucleotide encoding an engineered carboxyesterase polypeptide or a variant thereof, and one or more expression regulating regions such as a promoter and a terminator, a replication origin, etc., depending on the type of hosts into which they are to be introduced. The various nucleic acid and control sequences described above may be joined together to produce a recombinant expression vector which may include one or more convenient restriction sites to allow for insertion or substitution of the nucleic acid sequence encoding the polypeptide at such sites. Alternatively, the nucleic acid sequence of the present invention may be expressed by inserting the nucleic acid sequence or a nucleic acid construct comprising the sequence into an appropriate vector for expression. In creating the expression vector, the coding sequence is located in the vector so that the coding sequence is operably linked with the appropriate control sequences for expression.

The recombinant expression vector may be any vector (e.g., a plasmid or virus), which can be conveniently subjected to recombinant DNA procedures and can bring about the expression of the polynucleotide sequence. The choice of the vector will typically depend on the compatibility of the vector with the host cell into which the vector is to be introduced. The vectors may be linear or closed circular plasmids.

The expression vector may be an autonomously replicating vector (i.e., a vector that exists as an extrachromosomal entity), the replication of which is independent of chromosomal replication, (e.g., a plasmid, an extrachromosomal element, a minichromosome, or an artificial chromosome). The vector may contain any means for assuring self-replication. Alternatively, the vector may be one which, when introduced into the host cell, is integrated into the genome and replicated together with the chromosome(s) into which it has been integrated. Furthermore, a single vector or plasmid or two or more vectors or plasmids which together contain the total DNA to be introduced into the genome of the host cell, or a transposon may be used.

The expression vector of the present invention preferably contains one or more selectable markers, which permit easy selection of transformed cells. A selectable marker can be a gene the product of which provides for biocide or viral resistance, resistance to heavy metals, prototrophy to auxotrophs, and the like. Examples of bacterial selectable markers are the dal genes from *Bacillus subtilis* or *Bacillus lichenformis*, or markers, which confer antibiotic resistance such as ampicillin, kanamycin, chloramphenicol, or tetracycline resistance. Suitable markers for yeast host cells are ADE2, HIS3, LEU2, LYS2, MET3, TRP1, and URA3.

Selectable markers for use in a filamentous fungal host cell include, but are not limited to, amdS (acetamidase), argB (ornithine carbamoyltransferase), bar (phosphinothricin acetyltransferase), hph (hygromycin phosphotransferase), niaD (nitrate reductase), pyrG (orotidine-5'-phosphate decarboxylase), sC (sulfate adenyltransferase), and trpC (anthranilate synthase), as well as equivalents thereof. Embodiments for use in an *Aspergillus* cell include the amdS and pyrG genes of *Aspergillus nidulans* or *Aspergillus oryzae* and the bar gene of *Streptomyces hygroscopicus*.

The expression vectors of the present invention can contain an element(s) that permits integration of the vector into the host cell's genome or autonomous replication of the vector in the cell independent of the genome. For integration into the host cell genome, the vector may rely on the nucleic acid sequence encoding the polypeptide or any other element of the vector for integration of the vector into the genome by homologous or nonhomologous recombination.

Alternatively, the expression vector may contain additional nucleic acid sequences for directing integration by homologous recombination into the genome of the host cell. The additional nucleic acid sequences enable the vector to be integrated into the host cell genome at a precise location (s) in the chromosome(s). To increase the likelihood of integration at a precise location, the integrational elements should preferably contain a sufficient number of nucleic acids, such as 100 to 10,000 base pairs, preferably 400 to 10,000 base pairs, and most preferably 800 to 10,000 base pairs, which are highly homologous with the corresponding target sequence to enhance the probability of homologous recombination. The integrational elements may be any sequence that is homologous with the target sequence in the genome of the host cell. Furthermore, the integrational elements may be non-encoding or encoding nucleic acid sequences. On the other hand, the vector may be integrated into the genome of the host cell by non-homologous recombination.

For autonomous replication, the vector may further comprise an origin of replication enabling the vector to replicate autonomously in the host cell in question. Non-limiting examples of bacterial origins of replication are P15A ori or the origins of replication of plasmids pBR322, pUC19, pACYC177 (which plasmid has the P15A ori), or pACYC184 permitting replication in *E. coli*, and pUB110, pE194, or pTA1060, permitting replication in *Bacillus*. Examples of origins of replication for use in a yeast host cell are the 2 micron origin of replication, ARS1, ARS4, the combination of ARS1 and CEN3, and the combination of ARS4 and CEN6. The origin of replication may be one having a mutation which makes its functioning temperature-sensitive in the host cell (See, e.g., Ehrlich, Proc. Natl. Acad. Sci. USA 75:1433 [1978]).

More than one copy of a nucleic acid sequence of the present invention may be inserted into the host cell to increase production of the gene product. An increase in the copy number of the nucleic acid sequence can be obtained by integrating at least one additional copy of the sequence into the host cell genome or by including an amplifiable selectable marker gene with the nucleic acid sequence where cells containing amplified copies of the selectable marker gene, and thereby additional copies of the nucleic acid sequence, can be selected for by cultivating the cells in the presence of the appropriate selectable agent.

Many of the expression vectors for use in the present invention are commercially available. Suitable commercial expression vectors include, but are not limited to p3×FLAG™ expression vectors (Sigma-Aldrich), which include a CMV promoter and hGH polyadenylation site for expression in mammalian host cells and a pBR322 origin of replication and ampicillin resistance markers for amplification in *E. coli*. Other commercially available suitable expression vectors include but are not limited to the pBluescriptII SK(−) and pBK-CMV vectors (Stratagene), and plasmids derived from pBR322 (Gibco BRL), pUC (Gibco BRL), pREP4, pCEP4 (Invitrogen) or pPoly (See, Lathe et al., Gene 57:193-201 [1987]).

The skilled person will appreciate that, upon production of an enzyme, in particular, depending upon the cell line used and the particular amino acid sequence of the enzyme, post-translational modifications may occur. For example, such post-translational modifications may include the cleavage of certain leader sequences, the addition of various sugar moieties in various glycosylation and phosphorylation patterns, deamidation, oxidation, disulfide bond scrambling, isomerisation, C-terminal lysine clipping, and N-terminal glutamine cyclisation. The present invention encompasses the use of engineered carboxyesterase enzymes that have been subjected to, or have undergone, one or more post-translational modifications. Thus, the engineered carboxyesterases of the invention includes one which has undergone a post-translational modification, such as described herein.

Deamidation is an enzymatic reaction primarily converting asparagine (N) to iso-aspartic acid (iso-aspartate) and aspartic acid (aspartate) (D) at approximately 3:1 ratio. This deamidation reaction is, therefore, related to isomerization of aspartate (D) to iso-aspartate. The deamidation of asparagine and the isomerisation of aspartate, both involve the intermediate succinimide. To a much lesser degree, deamidation can occur with glutamine residues in a similar manner.

Oxidation can occur during production and storage (i.e., in the presence of oxidizing conditions) and results in a covalent modification of a protein, induced either directly by reactive oxygen species, or indirectly by reaction with secondary by-products of oxidative stress. Oxidation happens primarily with methionine residues, but may occur at tryptophan and free cysteine residues.

Disulfide bond scrambling can occur during production and basic storage conditions. Under certain circumstances, disulfide bonds can break or form incorrectly, resulting in unpaired cysteine residues (—SH). These free (unpaired) sulfhydryls (—SH) can promote shuffling.

N-terminal glutamine (Q) and glutamate (glutamic acid) (E) in the engineered carboxyesterases are likely to form pyroglutamate (pGlu) via cyclization. Most pGlu formation happens in manufacturing, but it can be formed non-enzymatically, depending upon pH and temperature of processing and storage conditions.

C-terminal lysine clipping is an enzymatic reaction catalyzed by carboxypeptidases, and is commonly observed in enzymes. Variants of this process include removal of lysine from the enzymes from the recombinant host cell.

In the present invention, the post-translational modifications and changes in primary amino acid sequence described above do not result in significant changes in the activity of the engineered carboxyesterase enzymes.

Host Cells for Expression of Carboxyesterase Polypeptides

In another aspect, the present invention provides a host cell comprising a polynucleotide encoding an improved carboxyesterase polypeptide of the present invention, the polynucleotide being operatively linked to one or more control sequences for expression of the carboxyesterase enzyme in the host cell. Host cells for use in expressing the carboxyesterase polypeptides encoded by the expression vectors of the present invention are well known in the art and include but are not limited to, bacterial cells, such as *E. coli, Geobacillus stearothermophilus, Lactobacillus kefir, Lactobacillus brevis, Lactobacillus minor, Mycobacterium tuberculosis, Streptomyces* and *Salmonella typhimurium* cells; fungal cells, such as yeast cells (e.g., *Saccharomyces cerevisiae* or *Pichia pastoris* (ATCC Accession No. 201178)); insect cells such as *Drosophila* S2 and *Spodoptera* Sf9 cells; animal cells such as CHO, COS, BHK, 293, and Bowes melanoma cells; and plant cells. Appropriate culture media and growth conditions for the above-described host cells are well known in the art.

Polynucleotides for expression of the carboxyesterase may be introduced into cells by various methods known in the art. Techniques include among others, electroporation, biolistic particle bombardment, liposome mediated transfection, calcium chloride transfection, and protoplast fusion. Various methods for introducing polynucleotides into cells will be apparent to the skilled artisan.

*Escherichia coli* W3110 is a host strain that finds use in the present invention, although it is not intended that the present invention be limited to this specific host strain. The expression vector was created by operatively linking a polynucleotide encoding an improved carboxyesterase into the plasmid pCK110900 operatively linked to the lac promoter under control of the lacI repressor. The expression vector also contained the P15a origin of replication and the chloramphenicol resistance gene. Cells containing the subject polynucleotide in *Escherichia coli* W3110 can be isolated by subjecting the cells to chloramphenicol selection.

Methods of Generating Engineered Carboxyesterase Polypeptides.

In some embodiments, to make the improved carboxyesterase polynucleotides and polypeptides of the present invention, the naturally-occurring carboxyesterase enzyme that catalyzes the hydrolysis reaction is obtained (or derived) from *X. campestris*. In some embodiments, the parent polynucleotide sequence is codon optimized to enhance expression of the carboxyesterase in a specified host cell. As an illustration, the parental polynucleotide sequence encoding the wild-type carboxyesterase polypeptide of *X. campestris* was constructed from oligonucleotides prepared based upon the known polypeptide sequence of *X. campestris* carboxyesterase sequence available in Genbank database (Genbank accession no. WP_011038606.1). The parental polynucleotide sequence, designated as SEQ ID NO: 1, was codon optimized for expression in *E. coli* and the codon-optimized polynucleotide cloned into an expression vector, placing the expression of the carboxyesterase gene under the control of the lac promoter and lacI repressor gene. Clones expressing the active carboxyesterase in *E. coli* were identified and the genes sequenced to confirm their identity. The codon-optimized polynucleotide sequence designated SEQ ID NO: 1 was the parent sequence utilized as the starting point for most experiments and library construction of engineered carboxyesterases evolved from the original wild-type carboxyesterase.

In some embodiments, engineered carboxyesterases are obtained by subjecting the polynucleotide encoding the naturally occurring carboxyesterase or a codon-optimized version of the polynucleotide encoding naturally-occurring carboxyesterase to mutagenesis and/or directed evolution methods, as discussed above. Mutagenesis may be performed in accordance with any of the techniques known in the art, including random and site-specific mutagenesis. Directed evolution can be performed with any of the techniques known in the art to screen for improved promoter variants including shuffling. Mutagenesis and directed evolution methods are well known in the art (See, e.g., U.S. Pat. Nos. 5,605,793, 5,811,238, 5,830,721, 5,834,252, 5,837,458, 5,928,905, 6,096,548, 6,117,679, 6,132,970, 6,165,793, 6,180,406, 6,251,674, 6,265,201, 6,277,638, 6,287,861, 6,287,862, 6,291,242, 6,297,053, 6,303,344, 6,309,883, 6,319,713, 6,319,714, 6,323,030, 6,326,204, 6,335,160, 6,335,198, 6,344,356, 6,352,859, 6,355,484, 6,358,740, 6,358,742, 6,365,377, 6,365,408, 6,368,861, 6,372,497, 6,337,186, 6,376,246, 6,379,964, 6,387,702, 6,391,552, 6,391,640, 6,395,547, 6,406,855, 6,406,910, 6,413,745, 6,413,774, 6,420,175, 6,423,542, 6,426,224, 6,436,675, 6,444,468, 6,455,253, 6,479,652, 6,482,647, 6,483,011, 6,484,105, 6,489,146, 6,500,617, 6,500,639, 6,506,602, 6,506,603, 6,518,065, 6,519,065, 6,521,453, 6,528,311, 6,537,746, 6,573,098, 6,576,467, 6,579,678, 6,586,182, 6,602,986, 6,605,430, 6,613,514, 6,653,072, 6,686,515, 6,703,240, 6,716,631, 6,825,001, 6,902,922, 6,917,882, 6,946,296, 6,961,664, 6,995,017, 7,024,312, 7,058,515, 7,105,297, 7,148,054, 7,220,566, 7,288,375, 7,384,387, 7,421,347, 7,430,477, 7,462,469, 7,534,564, 7,620,500, 7,620,502, 7,629,170, 7,702,464, 7,747,391, 7,747,393, 7,751,986, 7,776,598, 7,783,428, 7,795,030, 7,853,410, 7,868,138, 7,783,428, 7,873,477, 7,873,499, 7,904,249, 7,957,912, 7,981,614, 8,014,961, 8,029,988, 8,048,674, 8,058,001, 8,076,138, 8,108,150, 8,170,806, 8,224,580, 8,377,681, 8,383,346, 8,457,903, 8,504,498, 8,589,085, 8,762,066, 8,768,871, 9,593,326, 9,665,694, 9,684,771, and all related non-US counterparts; Ling et al., Anal. Biochem., 254(2):157-78 [1997]; Dale et al., Meth. Mol. Biol., 57:369-

74 [1996]; Smith, Ann. Rev. Genet., 19:423-462 [1985]; Botstein et al., Science, 229:1193-1201 [1985]; Carter, Biochem. J., 237:1-7 [1986]; Kramer et al., Cell, 38:879-887 [1984]; Wells et al., Gene, 34:315-323 [1985]; Minshull et al., Curr. Op. Chem. Biol., 3:284-290 [1999]; Christians et al., Nat. Biotechnol., 17:259-264 [1999]; Crameri et al., Nature, 391:288-291 [1998]; Crameri, et al., Nat. Biotechnol., 15:436-438 [1997]; Zhang et al., Proc. Nat. Acad. Sci. U.S.A., 94:4504-4509 [1997]; Crameri et al., Nat. Biotechnol., 14:315-319 [1996]; Stemmer, Nature, 370:389-391 [1994]; Stemmer, Proc. Nat. Acad. Sci. USA, 91:10747-10751 [1994]; WO 95/22625; WO 97/0078; WO 97/35966; WO 98/27230; WO 00/42651; WO 01/75767; and WO 2009/152336. It is not intended that the present invention be limited to any particular methods, as various methods find use in the art.

In some embodiments, where the improved enzyme property desired is thermal stability, enzyme activity may be measured after subjecting the enzyme preparations to a defined temperature and measuring the amount of enzyme activity remaining after heat treatments. Clones containing a polynucleotide encoding a carboxyesterase are then isolated, sequenced to identify the nucleotide sequence changes (if any), and used to express the enzyme in a host cell.

Where the sequence of the engineered polypeptide is known, the polynucleotides encoding the enzyme can be prepared by standard solid-phase methods, according to known synthetic methods. In some embodiments, fragments of up to about 100 bases can be individually synthesized, then joined (e.g., by enzymatic or chemical ligation methods or polymerase mediated methods) to form any desired continuous sequence. For example, polynucleotides and oligonucleotides of the invention can be prepared by chemical synthesis (e.g., using the classical phosphoramidite method described by Beaucage et al., Tet. Lett., 22:1859-69 [1981], or the method described by Matthes et al., EMBO J., 3:801-05 [1984], as it is typically practiced in automated synthetic methods). According to the phosphoramidite method, oligonucleotides are synthesized (e.g., in an automatic DNA synthesizer), purified, annealed, ligated and cloned in appropriate vectors. In addition, essentially any nucleic acid can be obtained from any of a variety of commercial sources (e.g., The Midland Certified Reagent Company, Midland, TX, The Great American Gene Company, Ramona, CA, ExpressGen Inc. Chicago, IL, Operon Technologies Inc., Alameda, CA, and many others).

Engineered carboxyesterase enzymes expressed in a host cell can be recovered from the cells and or the culture medium using any one or more of the well-known techniques for protein purification, including, among others, lysozyme treatment, sonication, filtration, salting-out, ultra-centrifugation, and chromatography. Suitable solutions for lysing and the high efficiency extraction of proteins from bacteria, such as *E. coli*, are commercially available under the trade name CelLytic B (Sigma-Aldrich).

Chromatographic techniques for isolation of the carboxyesterase polypeptide include, among others, reverse phase chromatography high performance liquid chromatography (HPLC), ion exchange chromatography, gel electrophoresis, and affinity chromatography. Conditions for purifying a particular enzyme will depend, in part, on factors such as net charge, hydrophobicity, hydrophilicity, molecular weight, molecular shape, etc., and will be apparent to those having skill in the art.

In some embodiments, affinity techniques may be used to isolate the improved carboxyesterase enzymes. For affinity chromatography purification, any antibody which specifically binds the carboxyesterase polypeptide may be used. For the production of antibodies, various host animals, including but not limited to rabbits, mice, rats, etc., may be immunized by injection with the carboxyesterase. The carboxyesterase polypeptide may be attached to a suitable carrier, such as BSA, by means of a side chain functional group or linkers attached to a side chain functional group. Various adjuvants may be used to increase the immunological response, depending on the host species, including but not limited to Freund's (complete and incomplete), mineral gels such as aluminum hydroxide, surface active substances such as lysolecithin, pluronic polyols, polyanions, peptides, oil emulsions, keyhole limpet hemocyanin, dinitrophenol, and potentially useful human adjuvants such as BCG (*Bacillus* Calmette Guerin) and *Corynebacterium parvum*.

The carboxyesterases may be prepared and used in the form of cells expressing the enzymes, as crude extracts, or as isolated or purified preparations. The carboxyesterases may be prepared as lyophilizates, in powder form (e.g., acetone powders), or prepared as enzyme solutions. In some embodiments, the carboxyesterases can be in the form of substantially pure preparations.

In some embodiments, the carboxyesterase polypeptides can be attached to a solid substrate. The substrate can be a solid phase, surface, and/or membrane. A solid support can be composed of organic polymers such as polystyrene, polyethylene, polypropylene, polyfluoroethylene, polyethyleneoxy, and polyacrylamide, as well as co-polymers and grafts thereof. A solid support can also be inorganic, such as glass, silica, controlled pore glass (CPG), reverse phase silica or metal, such as gold or platinum. The configuration of the substrate can be in the form of beads, spheres, particles, granules, a gel, a membrane or a surface. Surfaces can be planar, substantially planar, or non-planar. Solid supports can be porous or non-porous, and can have swelling or non-swelling characteristics. A solid support can be configured in the form of a well, depression, or other container, vessel, feature, or location. A plurality of supports can be configured on an array at various locations, addressable for robotic delivery of reagents, or by detection methods and/or instruments.

Methods of Using the Engineered Carboxyesterase Enzymes

Whole cells transformed with gene(s) encoding the engineered carboxyesterase enzyme and/or the optional cofactor regeneration enzymes, or cell extracts and/or lysates thereof, may be employed in a variety of different forms, including solid (e.g., lyophilized, spray-dried, and the like) or semisolid (e.g., a crude paste).

The cell extracts or cell lysates may be partially purified by precipitation (ammonium sulfate, polyethyleneimine, heat treatment or the like), followed by a desalting procedure prior to lyophilization (e.g., ultrafiltration, dialysis, and the like). Any of the cell preparations may be stabilized by crosslinking using known crosslinking agents, such as, for example, glutaraldehyde or immobilization to a solid phase (e.g., Eupergit C, and the like).

The solid reactants (e.g., enzyme, salts, etc.) may be provided to the reaction in a variety of different forms, including powder (e.g., lyophilized, spray dried, and the like), solution, emulsion, suspension, and the like. The reactants can be readily lyophilized or spray dried using methods and equipment that are known to those having ordinary skill in the art. For example, the protein solution can be frozen at −80° C. in small aliquots, then added to a prechilled lyophilization chamber, followed by the application of a vacuum. After the removal of water from the samples, the temperature is typically raised to 4° C. for two hours before release of the vacuum and retrieval of the lyophilized samples.

During the course of the reaction, the pH of the reaction mixture may change. The pH of the reaction mixture may be maintained at a desired pH or within a desired pH range. This may be done by the addition of an acid or a base, before and/or during the course of the reaction. Alternatively, the pH may be controlled by using a buffer. Accordingly, in some embodiments, the reaction condition comprises a buffer. Suitable buffers to maintain desired pH ranges are known in the art and include, by way of example and not limitation, borate, phosphate, 2-(N-morpholino)ethanesulfonic acid (MES), 3-(N-morpholino)propanesulfonic acid (MOPS), acetate, triethanolamine, and 2-amino-2-hydroxymethyl-propane-1,3-diol (Tris), and the like. In some embodiments, the buffer is tris. In some embodiments of the process, the suitable reaction conditions comprise a buffer (e.g., tris) concentration of from about 0.01 to about 0.4 M, 0.05 to about 0.4 M, 0.1 to about 0.3 M, or about 0.1 to about 0.2 M. In some embodiments, the reaction condition comprises a buffer (e.g., tris) concentration of about 0.01, 0.02, 0.03, 0.04, 0.05, 0.07, 0.1, 0.12, 0.14, 0.16, 0.18, 0.2, 0.3, or 0.4 M.

In the embodiments of the process, the reaction conditions can comprise a suitable pH. The desired pH or desired pH range can be maintained by use of an acid or base, an appropriate buffer, or a combination of buffering and acid or base addition. The pH of the reaction mixture can be controlled before and/or during the course of the reaction. In some embodiments, the suitable reaction conditions comprise a solution pH from about 4 to about 10, pH from about 5 to about 10, pH from about 5 to about 9, pH from about 6 to about 9, pH from about 6 to about 8. In some embodiments, the reaction conditions comprise a solution pH of about 4, 4.5, 5, 5.5, 6, 6.5, 7, 7.5, 8, 8.5, 9, 9.5, or 10.

In the embodiments of the processes herein, a suitable temperature can be used for the reaction conditions, for example, taking into consideration the increase in reaction rate at higher temperatures, and the activity of the enzyme during the reaction time period. Accordingly, in some embodiments, the suitable reaction conditions comprise a temperature of about 10° C. to about 60° C., about 10° C. to about 55° C., about 15° C. to about 60° C., about 20° C. to about 60° C., about 20° C. to about 55° C., about 25° C. to about 55° C., or about 30° C. to about 50° C. In some embodiments, the suitable reaction conditions comprise a temperature of about 10° C., 15° C., 20° C., 25° C., 30° C., 35° C., 40° C., 45° C., 50° C., 55° C., or 60° C. In some embodiments, the temperature during the enzymatic reaction can be maintained at a specific temperature throughout the course of the reaction. In some embodiments, the temperature during the enzymatic reaction can be adjusted over a temperature profile during the course of the reaction.

In some embodiments, the reaction conditions can comprise a surfactant for stabilizing or enhancing the reaction. Surfactants can comprise non-ionic, cationic, anionic and/or amphiphilic surfactants. Exemplary surfactants, include by way of example and not limitation, nonyl phenoxypolyethoxylethanol (NP40), Triton X-100, polyoxyethylene-stearylamine, cetyltrimethylammonium bromide, sodium oleylamidosulfate, polyoxyethylene-sorbitanmonostearate, hexadecyldimethylamine, etc. Any surfactant that may stabilize or enhance the reaction may be employed. The concentration of the surfactant to be employed in the reaction may be generally from 0.1 to 50 mg/ml, particularly from 1 to 20 mg/ml.

In some embodiments, the reaction conditions can include an antifoam agent, which aids in reducing or preventing formation of foam in the reaction solution, such as when the reaction solutions are mixed or sparged. Anti-foam agents include non-polar oils (e.g., minerals, silicones, etc.), polar oils (e.g., fatty acids, alkyl amines, alkyl amides, alkyl sulfates, etc.), and hydrophobic (e.g., treated silica, polypropylene, etc.), some of which also function as surfactants. Exemplary anti-foam agents include, Y-30® (Dow Corning), poly-glycol copolymers, oxy/ethoxylated alcohols, and polydimethylsiloxanes. In some embodiments, the anti-foam can be present at about 0.001% (v/v) to about 5% (v/v), about 0.01% (v/v) to about 5% (v/v), about 0.1% (v/v) to about 5% (v/v), or about 0.1% (v/v) to about 2% (v/v). In some embodiments, the anti-foam agent can be present at about 0.001% (v/v), about 0.01% (v/v), about 0.1% (v/v), about 0.5% (v/v), about 1% (v/v), about 2% (v/v), about 3% (v/v), about 4% (v/v), or about 5% (v/v) or more as desirable to promote the reaction.

The quantities of reactants used in the hydrolysis reaction will generally vary depending on the quantities of product desired, and concomitantly the amount of carboxyesterase substrate employed. The following guidelines can be used to determine the amounts of carboxyesterase, and/or amine. Generally, ester substrates can be employed at a concentration of about 5 to 200 grams/liter using from about 2 g/L to about 100 g/L of carboxyesterase.

Those having ordinary skill in the art will readily understand how to vary these quantities to tailor them to the desired level of productivity and scale of production.

The order of addition of reactants is not critical. The reactants may be added together at the same time to a solvent (e.g., monophasic solvent, biphasic aqueous co-solvent system, and the like), or alternatively, some of the reactants may be added separately, and some together at different time points. For example, the carboxyesterase and the carboxyesterase substrate may be added first to the solvent.

For improved mixing efficiency when an aqueous co-solvent system is used, the carboxyesterase may be added and mixed into the aqueous phase first. The organic phase may then be added and mixed in, followed by addition of the carboxyesterase substrate. Alternatively, the carboxyesterase substrate may be premixed in the organic phase, prior to addition to the aqueous phase Suitable conditions for carrying out the carboxyesterase-catalyzed hydrolysis reactions described herein include a wide variety of conditions which can be readily optimized by routine experimentation that includes, but is not limited to, contacting the engineered carboxyesterase enzyme and substrates at an experimental pH and temperature and detecting product, for example, using the methods described in the Examples provided herein.

The hydrolysis reaction is generally allowed to proceed until essentially complete, or near complete, coupling of substrates is obtained. Acid formation (product) can be monitored using known methods by detecting substrates and/or product. Suitable methods include, but are not limited to, gas chromatography, HPLC, and the like. Conversion yields of the acid product generated in the reaction mixture are generally greater than about 40%, may also be greater than about 45%, may also be greater than about 46%, may also be greater than about 47%, may also be greater than 48%, and are often greater than about 49%, wherein the maximum conversion of the racemic substrate of compounds (2a) and (2b) to compound (3a) is 50%.

EXAMPLES

Various features and embodiments of the present invention are illustrated in the following representative examples, which are intended to be illustrative, and not limiting.

In the experimental disclosure below, the following abbreviations apply: ppm (parts per million); M (molar); mM (millimolar), uM and μM (micromolar); nM (nanomolar); mol (moles); gm and g (gram); mg (milligrams); ug and μg (micrograms); L and l (liter); ml and mL (milliliter); cm (centimeters); mm (millimeters); um and μm (micrometers); sec. (seconds); min(s) (minute(s)); h(s) and hr(s) (hour(s)); U (units); MW (molecular weight); rpm (rotations per minute); ° C. (degrees Centigrade); RT (room temperature); MWD (multiple wavelength detector); CDS (coding sequence); DNA (deoxyribonucleic acid); RNA (ribonucleic acid); RP-HPLC (reversed-phased high performance liquid chromatography); FIOP (fold improvement over positive control); HTP (high throughput); LB (Luria broth); TFA (trifluoroacetic acid); MeCN (acetonitrile); TEoA (triethanolamine); THF (tetrahydrofuran); Sigma-Aldrich (Sigma-Aldrich, St. Louis, MO); Millipore (Millipore, Corp., Billerica MA); Difco (Difco Laboratories, BD Diagnostic Systems, Detroit, MI); Daicel (Daicel, West Chester, PA); Genetix (Genetix USA, Inc., Beaverton, OR); Molecular Devices (Molecular Devices, LLC, Sunnyvale, CA); Applied Biosystems (Applied Biosystems, part of Life Technologies, Corp., Grand Island, NY), Agilent (Agilent Technologies, Inc., Santa Clara, CA); Thermo Scientific (part of Thermo Fisher Scientific, Waltham, MA); Corning (Corning, Inc., Palo Alto, CA); and Bio-Rad (Bio-Rad Laboratories, Hercules, CA); Phenomenex (Phenomenex, Inc., Torrence, CA); Epicentre (Epicentre, Madison, WI).

Example 1

HTP Production of Engineered Carboxyesterase Polypeptides in pCK110900

The polynucleotide (SEQ ID NO: 1) encoding the polypeptide from *Xanthomonas campestris* having esterase activity (SEQ ID NO: 2) was cloned into a pCK110900 vector system (See e.g., U.S. Pat. No. 9,714,437, which is hereby incorporated by reference in its entirety) and subsequently expressed in *E. coli* W3110jhuA under the control of the lac promoter.

In a 96-well format, single colonies were picked and grown in 180 μL LB containing 1% glucose and 30 μg/mL CAM, at 30° C., 200 rpm, and 85% humidity. Following overnight growth, 20 μL of the grown cultures were transferred into a deep-well plate containing 380 μL of TB with 30 μg/mL CAM. The cultures were grown at 30° C., 250 rpm, and 85% humidity. When the optical density ($OD_{600}$) of the cultures reached 0.6-0.8, expression of the esterase gene was induced by addition of IPTG to a final concentration of 1 mM. Following induction, growth was continued for 18-20 hours. Cells were harvested by centrifugation at 4,000 rpm at 4° C. for 10 minutes and the media discarded. The cell pellets were stored at −80° C. until ready for use. Prior to performing the assay, cell pellets were resuspended in 400 μL of lysis buffer containing 1 mg/mL lysozyme, 0.5 mg/mL polymyxin B sulfate PMBS, 0.04 Units DNAse, and 50 mM Tris-HCL, pH 7.5. The plates were agitated with medium-speed shaking for 2 hours on a microtiter plate shaker at room temperature. The plates were then centrifuged at 4,000 rpm for 20 minutes at 4° C., and the clarified supernatants were used in the HTP assay reaction described below.

Example 2

Shake Flask Production of Engineered Carboxyesterase Polypeptides

Shake-flask procedures can be used to generate engineered esterase polypeptide shake-flask powders (SFP), which are useful for secondary screening assays and/or use in the biocatalytic processes described herein. Shake flask powder (SFP) preparation of enzymes provides a more purified preparation (e.g., up to 30% of total protein) of the engineered enzyme, as compared to the cell lysate used in HTP assays and also allows for the use of more concentrated enzyme solutions. To start the cultures, a single colony of *E. coli* containing a plasmid encoding an engineered polypeptide of interest was inoculated into 5 mL LB with 30 μg/mL CAM and 1% glucose. The culture was grown overnight (at least 16 hours) in an incubator at 30° C. with shaking at 250 rpm. The grown culture was diluted into 250 mL of TB with 30 μg/mL CAM in a 1L shake-flask to a final $OD_{600}$ of 0.05. The 250 mL culture was grown at 30° C. at 250 rpm, until $OD_{600}$ reached 0.6-0.8.

Expression of the esterase gene was induced by addition of IPTG to a final concentration of 1 mM, and growth was continued for an additional 18-20 hours. Cells were harvested by transferring the culture into a pre-weighed centrifuge bottle, then centrifuged at 7,000 rpm for 10 minutes at 4° C. The supernatant was discarded, and the remaining cell pellet was weighed. In some embodiments, the cells are stored at −80° C. until ready to use. For lysis, the cell pellet was resuspended in 6 mL of cold TEoA. The resuspended cells were lysed using a 110L MICROFLUIDIZER® processor system (Microfluidics). Cell debris was removed by centrifugation at 10,000 rpm for 60 minutes at 4° C. The clarified lysate was collected, frozen at −80° C., and then lyophilized, using standard methods known in the art. Lyophilization of frozen clarified lysate provides a dry shake-flask powder comprising crude engineered polypeptide.

Example 3

Production of Engineered Carboxyesterase Polypeptides: Fermentation Procedure In an aerated, agitated 15 L fermenter, 6.0 L of growth medium containing 0.88 g/L ammonium sulfate, 0.98 g/L of sodium citrate; 12.5 g/L of dipotassium hydrogen phosphate trihydrate, 6.25 g/L of potassium dihydrogen phosphate, 6.2 g/L of Tastone-154 yeast extract, 0.083 g/L ferric ammonium citrate, and 8.3 ml/L of a trace element solution containing 2 g/L of calcium chloride dihydrate, 2.2 g/L of zinc sulfate septahydrate, 0.5 g/L manganese sulfate monohydrate, 1 g/L cuprous sulfate heptahydrate, 0.1 g/L ammonium molybdate tetrahydrate and 0.02 g/L sodium tetraborate decahydrate were brought to a temperature of 30° C. The fermenter was inoculated with a late exponential culture of *E. coli* W3110, containing a plasmid with the esterase gene of interest, grown in a shake flask, as described in Example 2, to a starting $OD_{600}$ of 0.5 to 2.0. The fermenter was agitated at 500-1,500 rpm, and air was supplied to the fermentation vessel at 1.0-15.0 L/min to maintain dissolved oxygen level of 30% saturation or greater.

The pH of the culture was controlled at 7.0 by addition of 20% v/v ammonium hydroxide. Growth of the culture was maintained by the addition of a feed solution containing 500 g/L cerelose, 12 g/L ammonium chloride, and 10.4 g/L magnesium sulfate heptahydrate. After the culture reached an $OD_{600}$ of 50, the expression of ketoreductase was induced by the addition of isopropyl-β-D-thiogalactoside (IPTG) to a final concentration of 1 mM. The culture was grown for another 14 hours. The culture was then chilled to 4° C. and maintained at 4° C. until harvested. Cells were harvested by centrifugation at 5,000 G for 40 minutes in a Sorval RC12BP centrifuge at 4° C. Harvested cells were used directly in the following downstream recovery process or were stored at 4° C. until such use.

The cell pellet was resuspended in 2 volumes of 100 mM triethanolamine (chloride) buffer, pH 6.8, at 4° C. to each volume of wet cell paste. The intracellular esterase was released from the cells by passing the suspension through a homogenizer fitted with a two-stage homogenizing valve assembly using a pressure of 12,000 psi. The cell homogenate was cooled to 4° C. immediately after disruption. A solution of 10% w/v polyethyleneimine, pH 7.2, was added to the lysate to a final concentration of 0.5% w/v and stirred for 30 minutes. The resulting suspension was clarified by centrifugation at 5,000 G in a standard laboratory centrifuge for 30 minutes. The clear supernatant was decanted and concentrated ten fold using a cellulose ultrafiltration membrane with a molecular weight cut off of 30 Kd. The final concentrate was dispensed into shallow containers, frozen at −20° C., and lyophilized to powder. The esterase powder was stored at −80° C.

Example 4

HTP Screening of Engineered Polypeptides Derived from SEQ ID NO: 2 for Improved Enantiospecificity (E) for Compound (3a)

The engineered polynucleotide (SEQ ID NO: 1) encoding the polypeptide with esterase activity of SEQ ID NO: 2 was used to generate the engineered polypeptides of Table 4-1. These polypeptides displayed improved esterase activity and/or selectivity under the desired conditions e.g., the improvement in the formation of the acid product (3a), from the ester substrate, compound (2a and 2b racemate), as compared to the starting polypeptide (SEQ ID NO:2). The engineered polypeptides, having the amino acid sequences of even-numbered sequence identifiers were generated from the "backbone" amino acid sequence of SEQ ID NO: 2 as described below together with the HTP assay and analytical methods (Method 8.4) described in Example 8.

Directed evolution began with the polynucleotide set forth in SEQ ID NO: 1. Libraries of engineered polypeptides were generated using various well-known techniques (e.g., saturation mutagenesis, recombination of previously identified beneficial amino acid differences) and screened using HTP assay and analysis methods that measured the polypeptide's ability to produce compound (3a).

The HTP enzyme assay was carried out in 96-well shallow-well (300 μL volume) plates, in 100 μL total reaction volume/well. The reaction contained 50 μL lysate (described in example 1), 10% DMSO, 50 g/L substrate (racemic mixture of compounds (2a) and (2b)), 200 mM triethanolamine (TEoA) buffer pH 7.5. The reaction plate was heat-sealed and shaken at 600 rpm at 30° C. for 18 hours. Plates were sealed with a heat seal and incubated in a 2" throw Kuhner at 600 rpm. Reaction plates were quenched with 150 μL acetonitrile, mixed for 10 minutes, and then run on a Chiral HPLC described in Example 8, Method 8.4. The peak area of all four analytes (R-ester (2a), S-ester (2b), R-acid (3a), S-acid (3b)) was determined from the chiral HPLC to calculate the % conversion and enantiospecificity (E value). The % conversion calculated by using the formula (R-acid (3a)+S-acid (3b))/(R-ester (2a)+S-ester (2b)+R-acid (3a)+S-acid (3b))*100. The FIOP activity of each variant relative to SEQ ID NO 2 was calculated by dividing the % conversion of variant with % conversion of SEQ ID NO 2. To determine the enantiospecificity (E) of each variant, % ee of substrate and product was calculated by using the formula % ee (substrate)=((Peak area of Sester (2b)-Peak area of R-ester (2a)/(Peak area of R-ester (2a)+Peak area of S-ester (2b))*100, the % ee (product)=(Peak area of R-acid (3a)−S-acid (3b)/Peak area of R-acid (3a)+Peak area of S-acid (3b))*100. The enantiospecificity (E) value of each variant was determined from % ee of substrate and % ee of product by using the equation $E=\ln[(1-ee_s)/(1+ee_s/ee_p)]/\ln[(1+ee_s)/(1+ee_s/ee_p)]$. The FIOP E of each variant relative to SEQ ID NO 2 was calculated, and all the hit variants with improved activity and selectivity are listed in Table 4-1.

TABLE 4-1

Esterase Variant Activity Relative to SEQ ID NO: 2

| SEQ ID NO: (nt/aa) | Amino Acid Differences (Relative to SEQ ID NO: 2) | Percent Conversion Fold Improvement (Relative to SEQ ID NO: 2)† | E value Fold Improvement (Relative to SEQ ID NO: 2)‡ |
|---|---|---|---|
| 5/6 | W9C/M10I/Q51D/A54S/N70W/V82Q/A87P/P180L | +++ | + |
| 7/8 | W9C/M10I/R17V/N70W/R139H/S160G/G165Q | +++ | + |
| 9/10 | W9C/M10I/M11E/R49S/A54S/N70W/V82Q/A87P/M148L/P180L | +++ | + |
| 11/12 | W9C/M10I/Q51D/A54S/N70W/V73M/V82Q/Q110M/P180L | +++ | + |
| 13/14 | W9C/M10I/R17V/N70W/V73M/V82Q/A87P/P180L/A219H | +++ | + |
| 15/16 | W9C/M10I/Q51D/A54S/N70W/V73M/V82Q/8P10L/Q225S | +++ | + |
| 17/18 | W9C/M10I/Q51D/A54S/N70W/V73M/V82Q/P180L/A219H | +++ | + |
| 19/20 | W9C/M10I/Q51D/A54S/N70W/V73L/V82Q/N108H/P180L | +++ | + |

TABLE 4-1-continued

| Esterase Variant Activity Relative to SEQ ID NO: 2 | | | |
|---|---|---|---|
| SEQ ID NO: (nt/aa) | Amino Acid Differences (Relative to SEQ ID NO: 2) | Percent Conversion Fold Improvement (Relative to SEQ ID NO: 2)† | E value Fold Improvement (Relative to SEQ ID NO: 2)‡ |
| 21/22 | W9C/M10I/R17V/R49S/Q51D/A54S/N70W/V82Q/A87P/P180L/A219H | +++ | |
| 23/24 | W9C/M10I/M11E/R49S/N70W/V82Q/A87P/N108H/Q110M/P180L/T200H | +++ | + |
| 25/26 | W9C/M10I/R17C/Q51D/A54S/N70W/V82Q/A87P/N108H/Q110M/P180L/T200H | +++ | + |
| 27/28 | W9C/M10I/R49S/Q51D/A54S/N70W/V82Q/Q110M/M148L/P180L | +++ | + |
| 29/30 | W9C/M10I/L12P/Q51D/N70W/V73L/V82Q/M148L/P180L/T200H | +++ | + |
| 31/32 | W9C/M10I/R17H/N70W/V82Q/Q110M/M148L/P180L | +++ | + |
| 33/34 | W9C/M10I/Q51D/A54S/N70W/V73L/V82Q/Q110M/M148L/P180L | +++ | + |
| 35/36 | W9C/M10I/M11E/R17H/N70W/V73M/V82Q/A87P/P180L/A219H | +++ | ++ |
| 37/38 | W9C/M10I/R17V/A54S/N70W/V73L/V82Q/A87P/N108H/Q110M/M148L/P180L/T200H | +++ | + |
| 39/40 | W9C/M10I/M11E/R49S/Q51D/A54S/N70W/V82Q/A87P/N108H/P180L | +++ | + |
| 41/42 | W9C/M10I/R17V/N70W/A104M/S160E/G165Q | +++ | + |
| 43/44 | W9C/M10I/R49S/N70W/V73L/V82G/N108H/Q110M/M148L/P180L/Q225S | ++ | + |
| 45/46 | W9C/M10I/Q51D/N70W/V82Q/P180L/A219H | ++ | + |
| 47/48 | W9C/M10I/A54S/N70W/V82Q/P180L | ++ | + |
| 49/50 | W9C/M10I/R49S/Q51D/A54S/N70W/V73M/V82Q/M148L/P180L | ++ | + |
| 51/52 | W9C/M10I/A54S/N70W/V82Q/A87P/N108H/P180L/T200H | ++ | + |
| 53/54 | W9C/M10I/R17V/R49S/N70W/V82Q/M148L/P180L | ++ | + |
| 55/56 | W9C/M10I/R17H/A54S/N70W/V82Q/A87P/N108H/Q110M/P180L | ++ | + |
| 57/58 | W9C/M10I/A54S/N70W/V82G/P180L | ++ | + |
| 59/60 | W9C/M10I/Q51D/N70W/V82Q/Q110M/P180L/T200H | ++ | + |
| 61/62 | W9A/M10I/N70W/V82Q/P180L/T200A/V214W | ++ | + |
| 63/64 | W9C/M10I/R17C/N70W/V82Q/A87P/M148L/P180L/Q192M/A219H | ++ | + |
| 65/66 | W9C/M10I/N70W/V82Q/A87P/P180L | ++ | + |
| 67/68 | W9C/M10I/N70W/V73M/V82Q/A87P/P180L/T200H | ++ | ++ |
| 69/70 | W9C/M10I/Q51D/A54S/N70W/V82Q/P180L | ++ | + |
| 71/72 | W9C/M10I/N70W/V82Q/A87P/N108H/Q110M/P180L | ++ | + |
| 73/74 | W9C/M10I/R49S/A54S/N70W/V82Q/A87P/Q110M/P180L | ++ | + |
| 75/76 | W9C/M10I/M11E/N70W/V73M/V82Q/A87P/Q110M/P180L | ++ | ++ |
| 77/78 | W9C/M10I/R17V/Q51D/N70W/V73M/V82Q/A87P/N108H/Q110M/M148L/P180L/A219H | ++ | + |
| 79/80 | W9C/M10I/R49S/Q51D/N70W/V82Q/P180L/Q225S | ++ | + |
| 81/82 | W9C/M10I/R17H/N70W/V82Q/P180L/T200A/V214W | ++ | + |
| 83/84 | W9C/M10I/Q51D/N70W/V82Q/N108H/P180L | ++ | + |
| 85/86 | W9C/M10I/R17H/R49S/Q51D/A54S/N70W/V73M/V82Q/N108H/Q110M/M148L/P180L/Q192M/T200H/A219H | ++ | + |
| 87/88 | W9C/M10I/R49S/Q51D/A54S/N70W/V82Q/M148L/P180L/Q192M | ++ | + |
| 89/90 | W9C/M10I/R49S/A54S/N70W/V82Q/N108H/M148L/P180L/Q225S | ++ | + |
| 91/92 | W9C/M10I/N70W/V73M/V82Q/A87P/P180L/Q192M/A219H | ++ | +++ |
| 93/94 | W9C/M10I/A54S/N70W/V73M/V82Q/N108H/M148L/P180L/Q192M | ++ | + |
| 95/96 | W9R/M10I/M11E/L12P/Q51D/A54S/N70W/V73L/V82Q/Q110M/P180L | ++ | + |
| 97/98 | W9C/M10I/R17V/A54S/N70W/V73L/V82Q/N108H/Q110M/M148L/P180L | ++ | + |
| 99/100 | W9C/M10I/M11G/R17V/Q51D/A54S/N70W/V82Q/M148L/P180L/T200H | ++ | + |

TABLE 4-1-continued

Esterase Variant Activity Relative to SEQ ID NO: 2

| SEQ ID NO: (nt/aa) | Amino Acid Differences (Relative to SEQ ID NO: 2) | Percent Conversion Fold Improvement (Relative to SEQ ID NO: 2)† | E value Fold Improvement (Relative to SEQ ID NO: 2)‡ |
|---|---|---|---|
| 101/102 | W9C/M10I/R49S/Q51D/A54S/N70W/V82Q/M148L/P180L | ++ | + |
| 103/104 | W9C/M10I/R17V/N70W/V82Q/Q110M/M148L/P180L/T200H | ++ | + |
| 105/106 | W9C/M10I/Q51D/A54S/N70W/V82Q/P180L/T200H | ++ | + |
| 107/108 | W9C/M10I/R49S/N70W/V73L/V82Q/A87P/N108H/M148L/P180L | ++ | ++ |
| 109/110 | W9C/M10I/R49S/N70W/V82Q/A87P/M148L/P180L | ++ | + |
| 111/112 | W9C/M10I/N70W/V73L/V82Q/N108H/M148L/P180L | ++ | ++ |
| 113/114 | W9C/M10I/R49S/A54S/N70W/V73L/V82Q/A87P/Q110M/P180L | ++ | + |
| 115/116 | W9C/M10I/N70W/V73M/V82Q/N108H/M148L/P180L/Q192M/A219H | ++ | ++ |
| 117/118 | W9C/M10I/N70W/V73L/V82Q/N108H/P180L | ++ | ++ |
| 119/120 | W9C/M10I/N70W/V82Q/A87P/N108H/Q110M/P180L/Q192M | ++ | ++ |
| 121/122 | W9C/M10I/N70W/V73M/V82Q/N108H/Q110M/P180L/T200H/A219H | ++ | ++ |
| 123/124 | W9C/M10I/N70W/V73M/V82Q/N108H/M148L/P180L | ++ | ++ |
| 125/126 | W9C/M10I/N70W/V73M/V82Q/M148L/P180L | ++ | ++ |
| 127/128 | W9C/M10I/M11E/N70W/V73M/V82Q/M148L/P180L | ++ | ++ |
| 129/130 | W9C/M10I/M11E/N70W/V73L/V82Q/N108H/M148L/P180L | ++ | + |
| 131/132 | W9C/M10I/M11E/N70W/V73L/V82Q/M148L/P180L | ++ | + |
| 133/134 | W9C/M10I/M11I/N70W/V73L/V82Q/P180L/T200A/V214W | ++ | ++ |
| 135/136 | W9C/M10I/R17C/N70W/V73L/V82Q/N108H/Q110M/M148L/P180L/T200H | ++ | + |
| 137/138 | W9C/M10I/R49S/Q51D/N70W/V82Q/Q110M/M148L/P180L | ++ | + |
| 139/140 | W9C/M10I/R17C/N70W/V82Q/P180L/T200A/V214W | ++ | + |
| 141/142 | W9C/M10I/N70W/V73L/V82Q/N108H/M148L/P180L/Q192M | ++ | ++ |
| 143/144 | W9C/M10I/L12P/R49S/Q51D/A54S/N70W/V82Q/N108H/M148L/P180L/Q225S | ++ | + |
| 145/146 | W9C/M10I/M11I/N70V/V82Q/P180L/T200A/V214W | ++ | |
| 147/148 | W9C/M10I/M11E/R49S/N70W/V82Q/A87P/P180L | ++ | + |
| 149/150 | W9C/M10I/N70W/V73L/V82Q/A87P/N108H/Q110M/P180L | ++ | +++ |
| 151/152 | W9C/M10I/M11G/Q51D/A54S/N70W/V73L/V82Q/N108H/Q110M/P180L | ++ | ++ |
| 153/154 | W9C/M10I/M11I/N70W/V73M/V82Q/P180L/T200A/V214W | ++ | ++ |
| 155/156 | W9C/M10I/R17V/N70W/V82Q/A87P/M148L/P180L | ++ | + |
| 157/158 | W9C/M10I/M11E/N70W/V73M/V82Q/M148L/P180L/Q192M/T200H | ++ | ++ |
| 159/160 | W9T/M10I/M11R/L12P/Q51D/A54S/N70W/V73L/V82Q/N108H/M148L/P180L/Q225S | ++ | + |
| 161/162 | W9C/M10I/A178E | ++ | |
| 163/164 | W9C/M10I/N70W/V82Q/P180L/T200A/V214W | ++ | + |
| 165/166 | S3R/W9C/M10I/M11T/N70W/V82Q/A107F | ++ | + |
| 167/168 | W9C/M10I/R49S/Q51D/A54S/N70W/V82G/N108H/Q110M/M148L/P180L/Q225S | ++ | + |
| 169/170 | W9C/M10I/M11G/RI7C/R49S/N70W/V82Q/P180L/A219H | ++ | + |
| 171/172 | W9C/M10I/M11I/A35Q/N70W/V82Q/P180L/T200A/V214W | ++ | + |
| 173/174 | W9C/M10I/R17V/N70W/V82Q/P180L/T200A/V214W | ++ | + |
| 175/176 | T6P/W9C/M10I/M11T/D36N/N70W/V82Q/P180L/T200A/V214W/T229M | ++ | + |
| 177/178 | W9C/M10I/N70W/V73L/V82Q/P180L/Q192M | ++ | ++ |
| 179/180 | W9C/M10I/M11I/N70W | ++ | + |

TABLE 4-1-continued

| Esterase Variant Activity Relative to SEQ ID NO: 2 | | | |
|---|---|---|---|
| SEQ ID NO: (nt/aa) | Amino Acid Differences (Relative to SEQ ID NO: 2) | Percent Conversion Fold Improvement (Relative to SEQ ID NO: 2)† | E value Fold Improvement (Relative to SEQ ID NO: 2)‡ |
| 181/182 | W9C/M10I/D13E/N70W/V82Q | ++ | + |
| 183/184 | W9C/M10I/R49S/Q51D/N70W/V82Q/N108H/M148L/P180L/A219H | ++ | + |
| 185/186 | W9C/M10I/M11E/N70W/V82Q/A87P/Q110M/P180L/A219H | ++ | ++ |
| 187/188 | W9C/M10I/M11E/A54S/N70W/V82Q/A87P/P180L/Q192M | ++ | ++ |
| 189/190 | W9C/M10I/R17V/N70W/V82Q/N108H/M148L/P180L | ++ | + |
| 191/192 | W9C/M10I/M11E/R49S/Q51D/N70W/V82Q/N108H/Q110M/M148L/P180L | ++ | + |
| 193/194 | W9C/M10I/M11G/Q51D/N70W/V82Q/Q110M/P180L/Q192M/A219H | ++ | + |
| 195/196 | W9C/M10I/A186Q | ++ | |
| 197/198 | W9C/M10I/N70W/V82Q/Q110M/P180L/A219H | ++ | + |
| 199/200 | P4R/R8G/W9C/M10I/M11T/N70W/V82Q/P180L/T200A/V214W/T229M | ++ | + |
| 201/202 | P4R/R8G/W9C/M10I/D36N/S38Y/N70W/V82Q/P180L/T200A/V214W/T229M | ++ | + |
| 203/204 | W9C/M10I/N70W/V82Q/A87P/N108H/Q110M/M148L/P180L/Q192M/A219H | ++ | ++ |
| 205/206 | W9C/M10I/R17A/N70W/V82Q/P180L/T200A/V214W | ++ | + |
| 207/208 | W9C/M10I/M11E/R49S/Q51D/A54S/N70W/V82Q/A87P/N108H/Q110M/M148L/P180L/A219H | ++ | ++ |
| 209/210 | W9C/M10I/M11I/N70W/V73R/V82Q/P180L/T200A/V214W | ++ | ++ |
| 211/212 | P4R/T6P/W9C/M10I/M11I/S3 8Y/N70W/V82Q/P180L/A186F/T200A/V214W | ++ | + |
| 213/214 | W9C/M10I/N70W/V82Q/Q110M/M148L/P180L | ++ | + |
| 215/216 | W9C/M10I/M11E/L12P/Q51D/N70W/V73M/Q110M/M148L/P180L | ++ | + |
| 217/218 | W9C/M10I/N70R | ++ | |
| 219/220 | W9R/M10I/M11E/L12S/Q51D/A54S/N70W/V73M/V82Q/M148L/P180L/Q225S | ++ | + |
| 221/222 | W9R/M10I/M11E/L12P/Q51D/N70W/V73M/V82Q/M148L/P180L/T200H/Q225S | ++ | ++ |
| 223/224 | W9C/M10I/P45T/N70W | ++ | + |
| 225/226 | W9C/M10I/M11I/N70W/N71H/V82Q/P180L/T200A/V214W | ++ | + |
| 227/228 | W9C/M10I/N70W/V73L/V82Q/P180L/Q192M/A219H | ++ | ++ |
| 229/230 | W9C/M10I/A196Q | ++ | |
| 231/232 | T6P/W9C/M10I/N70W/V82Q/P180L/A186F/T200A/V214W/T229M | ++ | + |
| 233/234 | W9C/M10I/M11G/N70W/V82Q/P180L/T200A/V214W | ++ | + |
| 235/236 | W9C/M10I/M11I/D36N/S38Y/N70W/V82Q/P180L/T200A/V214W/T229M | ++ | + |
| 237/238 | P4R/R8G/W9C/M10I/M11T/D36N/N70W/V82Q/P180L/A186F/T200A/V214W/T229M | ++ | + |
| 239/240 | W9C/M10I/D13E/N70W/T229M | ++ | + |
| 241/242 | W9C/M10I/D39A/A186T | ++ | + |
| 243/244 | W9C/M10I/Q88G | ++ | |
| 245/246 | W9C/M10I/R49S/N70W/V82Q/Q110M/P180L/A219H | ++ | + |
| 247/248 | W9C/M10I/M11E/RI7H/Q51D/A54S/N70W/V82Q/P180L | ++ | + |
| 249/250 | W9C/M10I/Q51D/A54S/N70W/V82Q/M148L/P180L | ++ | + |
| 251/252 | W9C/M10I/N70W/V73L/V82Q/M148L/P180L/T200H | ++ | ++ |
| 253/254 | T6P/R8G/W9C/M10I/S38Y/N70W/V82Q/P180L/T200A/V214W | ++ | + |
| 255/256 | T6P/W9C/M10I/S38Y/N70W/V82Q/P180L/A186F/T200A/V214W/T229M | ++ | + |
| 257/258 | W9C/M10I/L12P/N70W/V82Q/P180L/T200A/V214W | ++ | + |
| 259/260 | W9C/M10I/N70W/G165Q | ++ | + |
| 261/262 | R8G/W9C/M10I/M11T/N70W | ++ | + |
| 263/264 | W9C/M10I/A196R | ++ | |
| 265/266 | W9C/M10I/N70W/V82Q/M148L/P180L/T200H | ++ | + |

TABLE 4-1-continued

| Esterase Variant Activity Relative to SEQ ID NO: 2 | | | |
|---|---|---|---|
| SEQ ID NO: (nt/aa) | Amino Acid Differences (Relative to SEQ ID NO: 2) | Percent Conversion Fold Improvement (Relative to SEQ ID NO: 2)† | E value Fold Improvement (Relative to SEQ ID NO: 2)‡ |
| 267/268 | W9C/M10I/N70W/V82Q/P180L | ++ | + |
| 269/270 | P4R/W9C/M10I/M11T/N70W/V82Q/P180L/T200A/V214W | ++ | + |
| 271/272 | W9T/M10I/M11E/L12P/Q51D/N70W/V73L/V82Q/M148L/P180L | ++ | + |
| 273/274 | W9C/M10I/M11I/A35S/N70W/V82Q/P180L/T200A/V214W | ++ | + |
| 275/276 | W9C/M10I/A26T | ++ | |
| 277/278 | W9C/M10I/N70W/V82Q/M148L/P180L | ++ | + |
| 279/280 | W9C/M10I/A111M | ++ | |
| 281/282 | W9C/M10I/A26G | ++ | |
| 283/284 | W9C/M10I/A226W | ++ | |
| 285/286 | S3R/R8G/W9C/M10I/N70W/T229M | ++ | + |
| 287/288 | W9C/M10I/M11E/N70W/V82Q/P180L | + | + |
| 289/290 | W9C/M10I/M11I/A35G/N70W/V82Q/P180L/T200A/V214W | + | + |
| 291/292 | W9C/M10I/M11E/Q51D/A54S/N70W/V82Q/M148L/P180L | + | + |
| 293/294 | W9C/M10I/R17Q/N70W/V82Q/P180L/T200A/V214W | + | + |
| 295/296 | W9C/M10I/M11E/RI7V/R49S/N70W/V82Q/P180L/T200H | + | + |
| 297/298 | P4R/T6P/W9C/M10I/M11I/D36N/N70W/V82Q/P180L/T200A/V214W/T229M | + | + |
| 299/300 | S3R/W9C/M11I/N70W/V82Q/P180L | + | + |
| 301/302 | W9C/M10I/N70W/V82Q/N108H/P180L | + | + |
| 303/304 | W9C/M10I/R17W | + | |
| 305/306 | W9C/M10I/N70W/V99R/T229M | + | + |
| 307/308 | W9C/M10I/D36N/N70W/V82Q/P180L/T200A/V214W | + | + |
| 309/310 | W9C/M10I/D13E/N70W | + | + |
| 311/312 | W9C/M10I/A41G | + | |
| 313/314 | W9C/M10I/M11T/N70W/V82Q/A107F | + | + |
| 315/316 | W9C/M10I/N70W/V82Q/N108H/Q110M/P180L/A219H | + | + |
| 317/318 | W9C/M10I/M11E/A54S/N70W/V82Q/M148L/P180L/T200H | + | + |
| 319/320 | W9C/M10I/R49S/Q51D/A54S/N70W/V82Q/Q110M/P180L | + | + |
| 321/322 | P4R/R8G/W9C/M10I/M11T/D36N/S38Y/N70W/V82Q/P180L/T200A/V214W/T229M | + | + |
| 323/324 | W9C/M10I/A41F | + | |
| 325/326 | R8G/W9C/M10I/M11T/M43I/N70W/V82Q/P180L/T200A/V214W | + | + |
| 327/328 | W9C/M10I/N70W/V82Q/P180L/Q192M/A219H | + | + |
| 329/330 | W9C/M10I/A107F | + | |
| 331/332 | W9C/M10I/N70W/V82Q/M148L/P180L/T200H/A219H | + | + |
| 333/334 | W9C/M10I/N70W | + | + |
| 335/336 | W9T/M10I/M11G/Q51D/A54S/N70W/V73L/V82Q/Q110M/M148L/P180L | + | ++ |
| 337/338 | W9C/M10I/R17S/N70W/V82Q/P180L/T200A/V214W | + | + |
| 339/340 | W9C/M10I/M11E/N70W/V82Q/M148L/P180L | + | + |
| 341/342 | W9C/M10I/N70W/A156E | + | + |
| 343/344 | W9C/M10I/M11T/N70W | + | + |
| 345/346 | W9C/M10I/M11T/N70W/V82Q | + | + |
| 347/348 | W9C/M10I/M11I/D36N/S38Y/R65I/N70W/V82Q/P180L/T200A/V214W/T229M | + | + |
| 349/350 | W9C/M10I/D39W | + | |
| 351/352 | S3R/R8G/W9C/M10I/M11T/N70W/T229M | + | + |
| 353/354 | W9C/M10I/A196S | + | |
| 355/356 | R8G/W9C/M10I/M11T/S38Y/N70W/V82Q/P180L/T200A/V214W/T229M | + | + |
| 357/358 | W9C/M10I/W29G/N70W | + | + |
| 359/360 | W9C/M10I/N70W/V99R | + | + |
| 361/362 | R8G/W9C/M10I/M11T/N70W/T229M | + | + |
| 363/364 | W9C/M10I/P45R/N70W | + | + |
| 365/366 | R8G/W9C/M10I/N70W/V82Q/T229M | + | + |
| 367/368 | S3R/W9C/M10I/N70W/V82Q | + | + |
| 369/370 | S3R/W9C/M10I/M11T/N70W/T229M | + | + |
| 371/372 | W9C/M10I/L12V/N70W/V82Q/P180L/T200A/V214W | + | + |

TABLE 4-1-continued

| SEQ ID NO: (nt/aa) | Amino Acid Differences (Relative to SEQ ID NO: 2) | Percent Conversion Fold Improvement (Relative to SEQ ID NO: 2)† | E value Fold Improvement (Relative to SEQ ID NO: 2)‡ |
|---|---|---|---|
| 373/374 | W9C/M10I/M11T/D36N/S38Y/N70W/V82Q/P180L/T200A/V214W/T229M | + | + |
| 375/376 | M11L/D36S/Y206F/M208A | + | |
| 377/378 | R8G/W9C/M10I/M11T/D13E/N70W | + | + |
| 379/380 | W9C/M10I/N70W/K92R | + | + |
| 381/382 | W9C/M10I/M11I/D36S/N70W/V82Q/P180L/T200A/V214W | + | + |
| 383/384 | W9C/M10I/M11I/N70W/V82Q/N108R/P180L/T200A/V214W | + | + |
| 385/386 | W9C/M10I/N70W/V82Q | + | + |
| 387/388 | W9C/M10I/M11I/D36N/N70W/V82Q/P180L/A196E/V214W | + | + |
| 389/390 | P4R/W9C/M10I/M11T/D36N/N70W/V82Q/P180L/T200A/V214W/T229M | + | + |
| 391/392 | W9C/M10I/M11I/N70W/N71R/V82Q/P180L/T200A/V214W | + | + |
| 393/394 | W9C/M10I/Q110V | + | |
| 395/396 | M11L/Q24T/A219D | + | |
| 397/398 | W9C/M10I/M11T/N70W/A107F | + | + |
| 399/400 | S3R/R8G/W9C/M10I/M11T/N70W | + | + |
| 401/402 | S3R/T6P/W9C/M10I/N70W/V99R | + | + |
| 403/404 | S3R/R8G/W9C/M10I/M11T/D13E/N70W/A107F | + | + |
| 405/406 | W9T/M10I/M11G/L12S/R49S/Q51D/N70W/V73M/V82Q/P180L/T200H/Q225S | + | ++ |
| 407/408 | S3R/R8G/W9C/M10I/D13E/N70W/V82Q/T229M | + | + |
| 409/410 | W9C/M10I/A96F | + | |
| 411/412 | P4R/W9C/M10I/M11T/D36N/N70W/V82Q/P180L/T200A/V214W | + | + |
| 413/414 | W9C/M10I/A133E | + | |
| 415/416 | W9C/M10I/M11E/RI7C/N70W/V82Q/M148L/P180L/A219H | + | + |
| 417/418 | W9C/M10I/M11E/R49S/Q51D/A54S/N70W/V82A/Q110M/M148L/P180L | + | + |
| 419/420 | S3R/R8G/W9C/M10I/N70W/V82Q/T229M | + | + |
| 421/422 | S3R/R8G/W9C/M10I/N70W/V82Q | + | + |
| 423/424 | R8G/W9C/M10I/M11T/D36N/S38Y/N70W/V82Q/P180L/T200A/V214W | + | + |
| 425/426 | R8G/W9C/M10I/M11T/D13E/N70W/V82Q | + | + |
| 427/428 | W9T/M10I/N70W/V73L/V82Q/N108H/Q110M/M148L/P180L | + | ++ |
| 429/430 | W9C/M10I/M11I/N70W/V82Q/A100S/P180L/T200A/V214W | + | + |
| 431/432 | W9C/M10I/M11I/F40V/N70W/V82Q/P180L/T200A/V214W | + | + |
| 433/434 | W9C/M10I/M11T/D36N/N70W/V82Q/P180L/T200A/V214W/T229M | + | + |
| 435/436 | W9C/M10I/N70W/A107F/T229M | + | + |
| 437/438 | W9C/M10I/N70W/V82Q/A107F/T229M | + | + |
| 439/440 | S3R/R8G/W9C/M10I/D13E/N70W/V82Q/A107F | + | + |
| 441/442 | W9C/M10I/N70W/T229M | + | + |
| 443/444 | W9C/M10I/M11I/N70W/A87V/P180L/T200A/V214W | + | + |
| 445/446 | S3R/W9C/M10I/M11I/D13E/V82Q | + | + |
| 447/448 | W9C/M10I/G37P | + | |
| 449/450 | S3R/R8G/W9C/M10I/M11T/D13E/N70W/V82Q/A107F/T229M | + | + |
| 451/452 | P4R/T6P/W9C/M10I/N70W/V82Q/T229M | + | + |
| 453/454 | W9C/M10I/R112G | + | |
| 455/456 | W9T/M10I/L12P/N70W/V82A/M148L/P180L/Q225S | + | + |
| 457/458 | W9C/M10I/M11G/A54S/N70W/V82Q/A87P/N108H/P180L | + | ++ |
| 459/460 | W9C/M10I/M11E/R49S/N70W/V82Q/Q110M/M148L/P180L/Q225S | + | + |
| 461/462 | R8G/W9C/M10I/M11T/N70W/V82Q/A107F/T229M | + | + |
| 463/464 | W9C/M10I/A133W | + | |
| 465/466 | W9T/M10I/M11G/Q51D/A54S/N70W/V73L/V82Q/N108H/P180L/T200H/Q225S | + | ++ |
| 467/468 | W9C/M10I/M11E/N70W/V82Q/P180L/T200A/V214W | + | + |
| 469/470 | P4R/R8G/W9C/M10I/M11T/D13E/N70W/V82Q/A107F/T229M | + | + |

TABLE 4-1-continued

| Esterase Variant Activity Relative to SEQ ID NO: 2 | | | |
|---|---|---|---|
| SEQ ID NO: (nt/aa) | Amino Acid Differences (Relative to SEQ ID NO: 2) | Percent Conversion Fold Improvement (Relative to SEQ ID NO: 2)† | E value Fold Improvement (Relative to SEQ ID NO: 2)‡ |
| 471/472 | W9C/M10I/A41S | + | |
| 473/474 | W9C/M10I/M11T/S38Y/N70W/V82Q/P180L/A186F/T200A/V214W | + | + |
| 475/476 | W9C/M10I/N70W/V82Q/A107F | + | + |
| 477/478 | W9C/M10I/M11I/D36N/S38Y/N70W/V82Q/P180L/T200A/V214W | + | + |
| 479/480 | P4R/W9C/M10I/M11T/D36N/R65I/N70W/V82Q/P180L/A186F/T200A/V214W | + | + |
| 481/482 | W9C/M10I/A62G | + | + |
| 483/484 | R8G/W9C/M10I/N70W | + | + |
| 485/486 | P4R/W9C/M10I/M11I/D36N/S38Y/N70W/V82Q/P180L/T200A/V214W/T229M | + | + |
| 487/488 | W9T/M10I/L12S/Q51D/A54S/N70W/P180L/Q225S | + | |
| 489/490 | W9C/M10I/M11I/N70W/V82A/P180L/T200A/V214W | + | + |
| 491/492 | W9C/M10I/Q211E | + | |
| 493/494 | W9T/M10I/M11E/L12N/R49S/N70W/V73M/V82Q/P180L | + | + |
| 495/496 | W9C/M10I/M11I/A54S/N70W/V82Q/P180L/T200A/V214W | + | + |
| 497/498 | W9C/M10I/A90S | + | |
| 499/500 | W9C/M10I/A226E | + | |
| 501/502 | W9C/M10I/M11I/A54P/N70W/V82Q/P180L/T200A/V214W | + | + |
| 503/504 | W9R/M10I/A54S/N70W/V82Q/P180L | + | + |
| 505/506 | W9C/M10I/S38Y/N70W/V82Q/P180L/T200A/V214W | + | + |
| 507/508 | M11L/Q24T | + | |
| 509/510 | W9C/M10I/N70W/V82Q/T229M | + | + |
| 511/512 | W9C/M10I/M11I/D36I/N70W/V82Q/P180L/T200A/V214W | + | + |
| 513/514 | R8G/W9C/M10I/M11T/D13E/N70W/V82Q/A107F/T229M | + | + |
| 515/516 | W9C/M10I/M11I/A54D/N70W/V82Q/P180L/T200A/V214W | + | + |
| 517/518 | R8A/W9C/M10I | + | |
| 519/520 | P4R/T6P/R8G/W9C/M10I/M11T/S38Y/N70W/V82Q/P180L/A186F/T200A/V214W/T229M | + | + |
| 521/522 | W9C/M10I/R185E | + | |
| 523/524 | W9R/M10I/N70W/V82Q/P180L/T200A/V214W | + | + |
| 525/526 | W9C/M10I/D13E/P207Q | + | |
| 527/528 | S3R/P4R/T6P/W9C/M10I/M11I/D36N/S38Y/N70W/V82Q/P180L/T200A/V214W/T229M | + | + |
| 529/530 | W9T/M10I/R49S/Q51D/A54S/N70W/V73M/V82Q/N108H/Q110M/M148L/P180L/Q192M | + | + |
| 531/532 | W9C/M10I/M11I/N70W/V82Q/M148L/P180L/T200A/V214W | + | + |
| 3/4 | S3R/W9C/M11I | + | + |
| 533/534 | W9C/M10I | + | + |
| 535/536 | W9C/M10I/M11I/N70W/V82Q/P180L/T200A/V214W | + | |

†Levels of increased activity were determined relative to the reference polypeptide of SEQ ID NO: 2 and defined as follows: "+" 1.00 to 3.75, "++" >3.75, "+++" >5.20
‡Levels of increased activity were determined relative to the reference polypeptide of SEQ ID NO: 2 and defined as follows: "+" 1.00 to 3.00, "++" >3.00, "+++" >6.00

Example 5

Shake Flask and Fermentation Powder Testing

The following procedure gives a reaction mixture with a starting substrate concentration of 100 g/L and 10% v/v DMSO. The volumes of enzyme powder solution and water can be varied to give different overall reaction enzyme concentrations. The reaction conditions for a 500 μL reaction comprised: 50 μL 1 M potassium phosphate buffer (pH 7.5), 150 μL DI water, 100 μL ester substrate (racemic mixture of compounds (2a) and (2b)) in DMSO (500 g/L stock in DMSO), and 200 μL diluted enzyme powder solution. An aliquot of 50 μL 1 M potassium phosphate buffer was added to a 4 mL glass vial equipped with a magnetic Teflon-coated stir bar; then, the DI water was added to the vial, followed by 100 μL of the stock solution of ester in DMSO. Finally, a 200 μL aliquot of enzyme powder solution was added to the vial to get the desired enzyme concentration. A PTFE-lined cap was screwed on to the vial, which was stirred at 30° C. and 900 rpm in a preheated aluminum block for 24 h.

The reactions were quenched by adding 2.5 mL of 50% v/v acetonitrile in water to each vial. The vials were stirred well, and the cloudy suspension was transferred to an Eppendorf tube. The tubes were centrifuged for ~10 minutes, to form a cell pellet and clarify the supernatant. The solution was decanted to a vial/plate and diluted 2× with 50% acetonitrile in water for both chiral (Method 8.2) and achiral HPLC (Method 8.1) analysis. The results of the shake flask powder testing are shown in Table 5-1.

TABLE 5-1

Shake Flask Powder Testing Results

| SEQ ID NO: | Enzyme g/L | Conversion | ee % Acid (2a) |
|---|---|---|---|
| 2 | 20 | 27.3% | 94.5% |
| 534 | 10 | 38.9% | 89.6% |
| 446 | 10 | 27.4% | 96.5% |
| 536 | 7.5 | 44.7% | 97.9% |
| 82 | 7.5 | 45.7% | 97.4% |

Example 6

Fermentation Powder Testing

A dose-response was performed according to the above protocol described in example 5, comparing SEQ ID NO: 536 fermentation powder and shake flask powder in a glass vial with magnetic stirring. The samples were processed and analyzed by the chiral (Example 8, Method 8.2) and non-chiral (Example 8, Method 8.1) methods. The data showed that the shake flask and fermentation powders showed similar results.

TABLE 6-1

Results of SEQ ID NO: 536 Shake Flask (SFP) and Fermentation Powder (FP)

| Dose (g/L) | Source | Conversion | ee % Acid (2a) |
|---|---|---|---|
| 4 | SFP | 43.9% | 98.4% |
| | FP | 43.2% | 98.6% |
| 6 | SFP | 50.0% | 97.9% |
| | FP | 48.8% | 98.0% |
| 8 | SFP | 48.8% | 97.4% |
| | FP | 49.0% | 97.8% |
| 10 | SFP | 50.6% | 96.8% |
| | FP | 51.4% | 96.5% |

Example 7 pH Stat Experiments

This general procedure was implemented for testing fermentation powders of SEQ ID NO: 268 and SEQ ID NO: 82. The titrants used include 0.2 M NaOH, 200 g/L $K_2CO_3$, and 0.2 M $K_2CO_3$. The following procedure gives a reaction mixture with a starting substrate concentration of 100 g/L, 10% v/v DMSO, and 1.25 g/L enzyme.

pH Stat Testing Protocol: Titronic 300 model was used for pH stat reactions, and the conditions for a 500 μL reaction comprised: 1.5 mL 1 M potassium phosphate buffer (pH 7.5), 10.19 mL DI water, 3.0 mL ester substrate (racemic mixture of compounds (2a) and (2b)) in DMSO, and 313 μL of 60 g/L enzyme powder solution. Potassium phosphate buffer was added to a 40 mL glass vial equipped with a magnetic cross-shaped Teflon-coated stir bar; DI water was added to the vial, followed by the solution of ester substrate in DMSO. The reaction was preheated to 40° C. by placing in an aluminum block and magnetically stirring at 500 rpm.

A pH probe in pH stat was added to the vial, ensuring the tip was covered in solution and stirring was maintained. The probe was threaded through an opening in a PTFE-lined cap. Data collection was started on pH stat; the probe was removed; and the enzyme solution was quickly added to the reaction. The probe was replaced and the cap screwed on, threading the needle to dispense the titrant through the cap, ensuring the needle was submerged in solution. Titrant was added, as the reaction proceeded, increasing the volume. As the volume increased, the rate of stirring was increased (usually to 700 rpm over 4-6 hours). After 20-24 hours, data collection was ended. The probe and needle were removed, and the reaction was quenched by solubilizing the entire reaction in 5× v/v 50% acetonitrile in water and stirring for 10 minutes. An aliquot of the solution was transferred to an Eppendorf tube and centrifuged for ~10 minutes. The results were analyzed by HPLC, as described according to the analytical Method 8.4 (described below).

pH Stat Testing Results: All reactions with the pH stat were performed according to the above procedure. Reactions were conducted at 40° C., under magnetic stirring (500 to 700 rpm) for a time of 20-24 hours.

TABLE 7-1 pH Stat Testing Results of SEQ ID NO: 268 and SEQ ID NO: 82.

| SFP (g/L) | Titrant | Enzyme SEQ ID NO: (nt/aa) | Conversion | % ee Acid | % ee Ester | mmol Titrant | Vol. titrant (mL) | Endpt. Substrate and product Conc. (g/L) | E-value |
|---|---|---|---|---|---|---|---|---|---|
| 1.25 | 200 g/L $K_2CO_3$ * | 267/268 | 32% | 98.5% | 46.4% | 0.75 | 0.52 | 96.6 | 210 |
| | | 81/82 | 24% | 98.7% | 30.6% | 0.89 | 0.62 | 96 | 206 |
| 1.25 | 0.2M $K_2CO_3$ | 267/268 | 42% | 98.4% | 70.9% | 1.11 | 5.55 | 73 | 264 |
| | | 81/82 | 39% | 98.3% | 62.9% | 1.12 | 5.62 | 72.7 | 223 |
| 1.25 | 0.2M NaOH | 267/268 | 46% | 98.2% | 84.1% | 2.1 | 10.5 | 58.8 | 295 |
| | | 81/82 | 45% | 98% | 79.2% | 2.06 | 10.31 | 59.3 | 241 |

Example 8

Analytical Methods

Achiral UPLC method was used in SFP testing, according to the parameters in Method 8-1.

Chiral HPLC Method 8.2 that was used for measuring the ee of the acid for routine shake flask powder testing, and the method details are given below.

| Achiral UHPLC Method 8.1 | | |
|---|---|---|
| Instrument | Thermo Fisher Vanquish | |
| Column | Waters Xbridge Peptide BEH C18 130 Å, 3.5 μm 4.6 × 150 mm | |
| Mobile Phase | Gradient (A: 0.1% TFA in water; B: 0.1% TFA in acetonitrile | |
| | Time(min) | % B |
| | 0.00 | 50 |
| | 0.50 | 90 |
| | 1.50 | 90 |
| | 1.60 | 50 |
| | 2.00 | 50 |
| Flow Rate | 2 mL/min | |
| Run time | 2.1 min | |
| Peak Retention Times | Acid ((3a) and (3b)) at 1.0 minutes; Ester ((2a) and (2b)) at 1.3 minutes | |
| Column Temperature | 50 | |
| Injection Volume | 0.5 μL | |
| UV Detection | 254 nm | |

| Chiral HPLC Method 8.2 | | |
|---|---|---|
| Instrument | Thermo Fisher UltiMate 3000 | |
| Column | Phenomenex Lux 3 μm Cellulose-3, 3 μm 4.6 × 150 mm | |
| Mobile Phase | Gradient (A: 0.1% TFA in water; B: 0.1% TFA in acetonitrile | |
| | Time(min) | % B |
| | 0.00 | 14 |
| | 10.5 | 14 |
| | 11.5 | 24 |
| | 18.0 | 24 |
| | 18.1 | 14 |
| | 21.0 | 14 |
| Flow Rate | 0.8 mL/min | |
| Run time | 21.0 min | |
| Peak Retention Times | S-acid (3b) product at 7.6 minutes; R-acid (3a) product at 8.5 minutes, S-ester (2b) substrate elute at 17.2 minutes and R-ester (2a) substrate elute at 18.2 minutes | |
| Column Temperature | 25 | |
| Injection Volume | 10 μL | |
| UV Detection | 254 nm | |

Chiral (Acid) HPLC Method 8.3 was used to evaluate enantioselectivity of shake flask reactions.

| Chiral HPLC Method 8.3 | | |
|---|---|---|
| Instrument | Thermo Fisher UltiMate 3000 | |
| Column | Phenomenex Lux 3 μm Cellulose-3, 3 μm 4.6 × 150 mm | |

-continued

| Chiral HPLC Method 8.3 | | |
|---|---|---|
| Instrument | Thermo Fisher UltiMate 3000 | |
| Mobile Phase | Gradient (A: 0.1% TFA in water; B: 0.1% TFA in acetonitrile | |
| | Time(min) | % B |
| | 0.00 | 14 |
| | 15.0 | 14 |
| | 15.1 | 86 |
| | 16.0 | 86 |
| | 16.1 | 14 |
| | 19.0 | 14 |
| Flow Rate | 0.8 mL/min | |
| Run time | 20.0 min | |
| Peak Retention Times | S-acid (3b) product at 8.5 minutes; R-acid (3a) product at 9.6 minutes, R&S-esters elute at 18.2 minutes | |
| Column Temperature | 25 | |
| Injection Volume | 10 μL | |
| UV Detection | 254 nm | |

Chiral HPLC Method 8.4 was used to measure conversion through acid and ester ee % s and was used in Example 4 and pH stat testing of SEQ ID NO: 268 and SEQ ID NO: 82.

| Chiral HPLC Method 8.4 | | |
|---|---|---|
| Instrument | Thermo Fisher UltiMate 3000 | |
| Column | Phenomenex Lux 3 μm Cellulose-3, 3 μm 4.6 × 150 mm | |
| Mobile Phase | Gradient (A: 0.1% TFA in water; B: 0.1% TFA in acetonitrile | |
| | Time(min) | % B |
| | 0.00 | 14 |
| | 15.0 | 14 |
| | 15.1 | 86 |
| | 16.0 | 86 |
| | 16.1 | 14 |
| | 19.0 | 14 |
| Flow Rate | 0.8 mL/min | |
| Run time | 21.0 min | |
| Peak Retention Times | S-acid (3b) product at 8.5 minutes; R-acid (3a) product at 9.6 minutes, R-ester (2b): 17.9 min S-ester: 19.0 min | |
| Column Temperature | 25 | |
| Injection Volume | 10 μL | |
| UV Detection | 270 nm | |

While various specific embodiments have been illustrated and described, it will be appreciated that various changes can be made without departing from the spirit and scope of the invention(s).

SEQUENCE LISTING (536 sequences)

SEQ ID NO: 1 - DNA, 693 bp, Artificial Sequence
  Wild Type Esterase from  Xanthomonas campestris
atgccaagtcctgttactggtcgctggatgatgttagatgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatcaacaatggcgttcgcatgcgtggttggtacgacatcgtggggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcaccgcggtt

SEQ ID NO: 2 - protein, 231 aa, Artificial Sequence
  Wild Type Esterase from  Xanthomonas campestris
MPSPVTGRWMMLDVIERETGPNPQWAVIWLHGLGADGSDFAPMVPELVRPQWPALRFVFPHAPIRPITINNGVRMRGWYDIVGMDFAQRADKVGIAESVAQVEALIANEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFTAV

SEQ ID NO: 3 - DNA, 693 bp, Artificial Sequence
  Engineered Variants of Esterase  from  Xanthomonas campestris
atgcctagacctgtaacaggtcgttgtatgattttggatgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatcaacaatggcgttcgcatgcgtggttggtacgacatcgtggggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcaccgcggtt

SEQ ID NO: 4 - protein, 231 aa, Artificial Sequence
  Engineered Variants of Esterase  from  Xanthomonas campestris
MPRPVTGRCMILDVIERETGPNPQWAVIWLHGLGADGSDFAPMVPELVRPQWPALRFVFPHAPIRPITINNGVRMRGWYDIVGMDFAQRADKVGIAESVAQVEALIANEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFTAV

SEQ ID NO: 5 - DNA, 693 bp, Artificial Sequence
  Engineered Variants of Esterase  from  Xanthomonas campestris
atgccgagccccgtgactggtcgatgcattatgttagacgtgattgaacgtgaaaccggtccaaacccccaatgggccgtgatttggctgcatggcttgggtgctgatggttctgactttgcaccgatggttccggaactggtccgtccagactggccatcgttacgcttcgtgtttcctcacgcgccgattcgtccgatcacgatctggaatggcgtgcgcatgcgtggttggtacgacatccaagggatggacttcccgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaagcattgcaagcattaggtttcacgcttgaatggcatagctacccgatgggccatcaagtgtgcgtagaggaaatcgatgcacttcgtgattggatgcaggctcgcttcaccgcggtt

SEQ ID NO: 6 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPDWPSLRFVFPHAPIRPITIWNGVRMRGWYDIQGMDFPQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFTLEWHSYPMGHQVCVEEIDALRDWMQARFTAV

SEQ ID NO: 7 - DNA, 693 bp, Artificial Sequence
  Engineered Variants of Esterase  from  Xanthomonas campestris
atgccgagccccgtgactggtcgatgtattatgttagatgtgattgaagttgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatcgtggggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcatgttccattagcgggcctgattgcgatgtccacctacttaccagatccagccgctgccgccgggcaactgcaaccgcaagcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaagcccgcttcaccgcggtt

SEQ ID NO: 8 - protein, 231 aa, Artificial Sequence
  Engineered Variants of Esterase  from  Xanthomonas campestris
MPSPVTGRCIMLDVIEVETGPNPQWAVIWLHGLGADGSDFAPMVPELVRPQWPALRFVFPHAPIRPITIWNGVRMRGWYDIVGMDFAQRADKVGIAESVAQVEALIANEQARGIAPDRILLAGFSQGGAVTLAVGLQRHVPLAGLIAMSTYLPDPAAAAGQLQPQALAQPLFMAHGSADPVVPYRAGEQSAQALQALGFTLEWHSYPMGHQVCVEEIDALRDWMQARFTAV

SEQ ID NO: 9 - DNA, 693 bp, Artificial Sequence
  Engineered Variants of Esterase  from  Xanthomonas campestris
atgccgagccccgtgactggtcgatgcattgagttagacgtgattgaacgtgaaaccggtccaaacccccaatgggccgtgatttggctgcatggcttgggtgctgatggttctgactttgcaccgatggttccggaactggtcagtccacaatggccatcgttacgcttcgtgtttcctcacgcgccgattcgtccgatcacgatctggaatggcgttcgcatgcgtggttggtacgacatccaagggatggacttcccgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcacaagcattgcaagcattaggtttcacccttgaatggcatagctacccgatgggccatcaagtgtgcgtagaggaaatcgatgcacttcgtgattggatgcaggctcgcttcaccgcggtt

SEQ ID NO: 10 - protein, 231 aa, Artificial Sequence
  Engineered Variants of Esterase  from  Xanthomonas campestris
MPSPVTGRCIELDVIERETGPNPQWAVIWLHGLGADGSDFAPMVPELVSPQWPSLRFVFPHAPIRPITIWNGVRMRGWYDIQGMDFPQRADKVGIAESVAQVEALIANEQARGIAPDRILLAGFSQGGAVTLAVGLQRRVPLAGLIALSTYLPDPAAAASQLQPGALAQPLFMAHGSADLVVPYRAGEQSAQALQALGFTLEWHSYPMGHQVCVEEIDALRDWMQARFTAV

SEQ ID NO: 11 - DNA, 693 bp, Artificial Sequence
  Engineered Variants of Esterase  from  Xanthomonas campestris
atgccgagccccgtgactggtcgatgcattatgttagacgtgattgaacgtgaaaccggtccaaacccccaatgggccgtgatttggctgcatggcttgggtgctgatggttctgactttgcaccgatggttccggaactggtccgtccagactggccatcgttacgcttcgtgtttcctcacgcgccgattcgtccgatcacgatctggaatggcatgcgcatgcgtggttggtacgacatccaagggatggacttcgcgcaacgtgcggataaggtgggtattgcggagagtgttgcacaagttgaagccctgattgctaatgaaatggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaagcattgcaagcattaggtttcacgcttgaatggcatagctacccgatgggccatcaagtgtgcgtagaggaaatcgatgcacttcgtgattggatgcaggctcgcttcaccgcggtt

SEQ ID NO: 12 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPDWPSLRFVFPHAPIRPITIWNGMRMRGWYDIQGMDFAQRADKVGIAESVAQVEALIANEMARGIAPDRILLAGFSQGGAVTLAVGLQRRVPLAGLIAMSTYLPDPAAAASQLQPGALAQPLFMAHGSADLVVPYRAGEQSAQALQALGFTLEWHSYPMGHQVCVEEIDALRDWMQARFTAV

SEQ ID NO: 13 - DNA, 693 bp, Artificial Sequence
  Engineered Variants of Esterase  from  Xanthomonas campestris
atgccgagccccgtgactggtcgatgcattatgttagacgtgattgaagtggaaaccggtccaaacccccaatgggccgtgatttggctgcatggcttgggtgctgatggttctgactttgcaccgatggttccggaactggtccgtccacaatggccagcgttacgcttcgtgtttcctcacgcgccgattcgtccgatcacgatctggaatggcatgcgcatgcgtggttggtacgacatccaagggatggacttcccgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcacgcttgaatggcatagctacccgatgggccatcaagtgtgcgtagaggaaatcgatcatcttcgtgattggatgcaggctcgcttcaccgcggtt

SEQ ID NO: 14 - protein, 231 aa, Artificial Sequence
  Engineered Variants of Esterase  from  Xanthomonas campestris
MPSPVTGRCIMLDVIEVETGPNPQWAVIWLHGLGADGSDFAPMVPELVRPQWPALRFVFPHAPIRPITIWNGMRMRGWYDIQGMDFPQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFTLEWHSYPMGHQVCVEEIDHLRDWMQARFTAV

SEQ ID NO: 15 - DNA, 693 bp, Artificial Sequence
  Engineered Variants of Esterase  from  Xanthomonas campestris
atgccgagccccgtgactggtcgatgcattatgttagacgtgattgaacgtgaaaccggtccaaacccccaatgggccgtgatttggctgcatggcttgggtgctgatggttctgactttgcaccgatggttccggaactggtccgtccagactggccatcgttacgcttcgtgtttcctcacgcgccgattcgtccgatcacgatctggaatggcatgcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcacccttgaatggcatagctacccgatgggccatcaagtgtgcgtagaggaaatcgatgcccttcgtgattggatgtcggctcgcttcaccgcggtt

SEQ ID NO: 16 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPDWPSLRFVFPHAPIRPITIWNGMRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFTLEWHSYPMGHQVCVEEIDALRDWMSARFTAV

SEQ ID NO: 17 - DNA, 693 bp, Artificial Sequence
  Engineered Variants of Esterase  from  Xanthomonas campestris
atgccgagccccgtgactggtcgatgcattatgttagacgtgattgaacgtgaaaccggtccaaacccccaatgggccgtgatttggctgcatggcttgggtgctgatggttctgactttgcaccgatggttccggaactggtccgtccagactggccatcgttacgcttcgtgtttcctcacgcgccgattcgtccgatcacgatctggaatggcatgcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcacccttgaatggcatagctacccgatgggccatcaagtgtgcgtagaggaaatcgatcatcttcgtgattggatgcaggctcgcttcaccgcggtt

SEQ ID NO: 18 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPDWPSLRFVFPHAPIRPITIWNGMRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFTLEWHSYPMGHQVCVEEIDHLRDWMQARFTAV

SEQ ID NO: 19 - DNA, 693 bp, Artificial Sequence
  Engineered Variants of Esterase  from  Xanthomonas campestris
atgccgagccccgtgactggtcgatgcattatgttagacgtgattgaacgtgaaaccggtccaaacccccaatgggccgtgatttggctgcatggcttgggtgctgatggttctgactttgcaccgatggttccggaactggtccgtccagactggccatcgttacgcttcgtgtttcctcacgcgccgattcgtccgatcacgatctggaatggcctgcgcatgcgtggttggtacgacatccaagggatggacttcgcgcaacgtgcggataaggtgggtattgcggagagtgttgcacaagttgaagccctgattgctcatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcacccttgaatggcatagctacccgatgggccatcaagtgtgcgtagaggaaatcgatgcacttcgtgattggatgcaggctcgcttcaccgcggtt

SEQ ID NO: 20 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPDWPSLRFVFPHAPIRPITIWNGLRMRGWYDIQGMDFAQRADKVGIAESVAQVEALIAHEQARGIAPDRILLAGFSQGGAVTLAVGLQRRVPLAGLIAMSTYLPDPAAAASQLQPGALAQPLFMAHGSADLVVPYRAGEQSAQALQALGFTLEWHSYPMGHQVCVEEIDALRDWMQARFTAV

SEQ ID NO: 21 - DNA, 693 bp, Artificial Sequence
  Engineered Variants of Esterase  from  Xanthomonas campestris
atgccgagccccgtgactggtcgatgcattatgttagacgtgattgaagtggaaaccggtccaaacccccaatgggccgtgatttggctgcatggcttgggtgctgatggttctgactttgcaccgatggttccggaactggtcagtccagactggccatcgttacgcttcgtgtttcctcacgcgccgattcgtccgatcacgatctggaatggcgttcgcatgcgtggttggtacgacatccaagggatggacttcccgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcacccttgaatggcatagctacccgatgggccatcaagtgtgcgtagaggaaatcgatcatcttcgtgattggatgcaggctcgcttcaccgcggtt

SEQ ID NO: 22 - protein, 231 aa, Artificial Sequence
  Engineered Variants of Esterase  from  Xanthomonas campestris
MPSPVTGRCIMLDVIEVETGPNPQWAVIWLHGLGADGSDFAPMVPELVSPDWPSLRFVFPHAPIRPITIWNGVRMRGWYDIQGMDFPQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFTLEWHSYPMGHQVCVEEIDHLRDWMQARFTAV

SEQ ID NO: 23 - DNA, 693 bp, Artificial Sequence
  Engineered Variants of Esterase  from  Xanthomonas campestris
atgccgagccccgtgactggtcgatgcattgagttagacgtgattgaacgtgaaaccggtccaaacccccaatgggccgtgatttggctgcatggcttgggtgctgatggttctgactttgcaccgatggttccggaactggtcagtccacaatggccagcgttacgcttcgtgtttcctcacgcgccgattcgtccgatcacgatctggaatggcgttcgcatgcgtggttggtacgacatccaagggatggacttcccgcaacgtgcggataaggtgggtattgcggagagtgttgcacaagttgaagccctgattgctcatgaaatggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttccatcttgaatggcatagctacccgatgggccatcaagtgtgcgtagaggaaatcgatgcccttcgtgattggatgcaggctcgcttcaccgcggtt

SEQ ID NO: 24 - protein, 231 aa, Artificial Sequence
  Engineered Variants of Esterase  from  Xanthomonas campestris
MPSPVTGRCIELDVIERETGPNPQWAVIWLHGLGADGSDFAPMVPELVSPQWPALRFVFPHAPIRPITIWNGVRMRGWYDIQGMDFPQRADKVGIAESVAQVEALIAHEMARGIAPDRILLAGFSQGGAVTLAVGLQRRVPLAGLIAMSTYLPDPAAAASQLQPGALAQPLFMAHGSADLVVPYRAGEQSAQALQALGFHLEWHSYPMGHQVCVEEIDALRDWMQARFTAV

SEQ ID NO: 25 - DNA, 693 bp, Artificial Sequence
  Engineered Variants of Esterase  from  Xanthomonas campestris
atgccgagccccgtgactggtcgatgcattatgttagacgtgattgaatgcgaaaccggtccaaacccccaatgggccgtgatttggctgcatggcttgggtgctgatggttctgactttgcaccgatggttccggaactggtccgtccagactggccatcgttacgcttcgtgtttcctcacgcgccgattcgtccgatcacgatctggaatggcgtgcgcatgcgtggttggtacgacatccaagggatggacttcccgcaacgtgcggataaggtgggtattgcggagagtgttgcacaagttgaagccctgattgctcatgaaatggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttccatcttgaatggcatagctacccgatgggccatcaagtgtgcgtagaggaaatcgatgcacttcgtgattggatgcaggctcgcttcaccgcggtt

SEQ ID NO: 26 - protein, 231 aa, Artificial Sequence
  Engineered Variants of Esterase  from  Xanthomonas campestris
MPSPVTGRCIMLDVIECETGPNPQWAVIWLHGLGADGSDFAPMVPELVRPDWPSLRFVFPHAPIRPITIWNGVRMRGWYDIQGMDFPQRADKVGIAESVAQVEALIAHEMARGIAPDRILLAGFSQGGAVTLAVGLQRRVPLAGLIAMSTYLPDPAAAASQLQPGALAQPLFMAHGSADLVVPYRAGEQSAQALQALGFHLEWHSYPMGHQVCVEEIDALRDWMQARFTAV

SEQ ID NO: 27 - DNA, 693 bp, Artificial Sequence
  Engineered Variants of Esterase  from  Xanthomonas campestris
atgccgagccccgtgactggtcgatgcattatgttagacgtgattgaacgtgaaaccggtccaaacccccaatgggccgtgatttggctgcatggcttgggtgctgatggttctgactttgcaccgatggttccggaactggtcagtccagactggccatcgttacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaacgaaatggcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcacccttgaatggcatagctacccgatgggccatcaagtgtgcgtagaggaaatcgatgcccttcgtgattggatgcaagctcgcttcaccgcggtt

SEQ ID NO: 28 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVSPDWPSLRFVFPHAPIRPITIWNGVRMRGWYDIQGMDFAQRADKVGIAESVAQVEALIANEMARGIAPDRILLAGFSQGGAVTLAVGLQRRVPLAGLIALSTYLPDPAAAASQLQPGALAQPLFMAHGSADLVVPYRAGEQSAQALQALGFTLEWHSYPMGHQVCVEEIDALRDWMQARFTAV

SEQ ID NO: 29 - DNA, 693 bp, Artificial Sequence
  Engineered Variants of Esterase  from  Xanthomonas campestris
atgccgagccccgtgactggtcgatgcattatgccggacgtgattgaacgtgaaaccggtccaaacccccaatgggccgtgatttggctgcatggcttgggtgctgatggttctgactttgcaccgatggttccggaactggtccgtccagactggccagcgttacgcttcgtgtttcctcacgcgccgattcgtccgatcacgatctggaatggcctgcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttccatcttgaatggcatagctacccgatgggccatcaagtgtgcgtagaggaaatcgatgcccttcgtgattggatgcaggctcgcttcaccgcggtt

SEQ ID NO: 30 - protein, 231 aa, Artificial Sequence
  Engineered Variants of Esterase  from  Xanthomonas campestris
MPSPVTGRCIMPDVIERETGPNPQWAVIWLHGLGADGSDFAPMVPELVRPDWPALRFVFPHAPIRPITIWNGLRMRGWYDIQGMDFAQRADKVGIAESVAQVEALIANEQARGIAPDRILLAGFSQGGAVTLAVGLQRRVPLAGLIALSTYLPDPAAAASQLQPGALAQPLFMAHGSADLVVPYRAGEQSAQALQALGFHLEWHSYPMGHQVCVEEIDALRDWMQARFTAV

SEQ ID NO: 31 - DNA, 693 bp, Artificial Sequence
  Engineered Variants of Esterase  from  Xanthomonas campestris
atgccgagccccgtgactggtcgatgcattatgttagacgtgattgaacacgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaaatggcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggctcgcttcaccgcggtt

SEQ ID NO: 32 - protein, 231 aa, Artificial Sequence
  Engineered Variants of Esterase  from  Xanthomonas campestris
MPSPVTGRCIMLDVIEHETGPNPQWAVIWLHGLGADGSDFAPMVPELVRPQWPALRFVFPHAPIRPITIWNGVRMRGWYDIQGMDFAQRADKVGIAESVAQVEALIANEMARGIAPDRILLAGFSQGGAVTLAVGLQRRVPLAGLIALSTYLPDPAAAASQLQPGALAQPLFMAHGSADLVVPYRAGEQSAQALQALGFTLEWHSYPMGHQVCVEEIDALRDWMQARFTAV

SEQ ID NO: 33 - DNA, 693 bp, Artificial Sequence
  Engineered Variants of Esterase  from  Xanthomonas campestris
atgccgagccccgtgactggtcgatgcattatgttagacgtgattgaacgcgaaaccggtccaaacccccaatgggccgtgatttggctgcatggcttgggtgctgatggttctgactttgcaccgatggttccggaactggtccgtccagactggccatcgttacgcttcgtgtttcctcacgcgccgattcgtccgatcacgatctggaatggcctgcgcatgcgtggttggtacgacatccaagggatggacttcgcgcaacgtgcggataaggtgggtattgcggagagtgttgcacaagttgaagccctgattgctaatgaaatggcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcacgcttgaatggcatagctacccgatgggccatcaagtgtgcgtagaggaaatcgatgcacttcgtgattggatgcaggctcgcttcaccgcggtt

SEQ ID NO: 34 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPDWPSLRFVFPHAPIRPITIWNGLRMRGWYDIQGMDFAQRADKVGIAESVAQVEALIANEMARGIAPDRILLAGFSQGGAVTLAVGLQRRVPLAGLIALSTYLPDPAAAASQLQPGALAQPLFMAHGSADLVVPYRAGEQSAQALQALGFTLEWHSYPMGHQVCVEEIDALRDWMQARFTAV

SEQ ID NO: 35 - DNA, 693 bp, Artificial Sequence
  Engineered Variants of Esterase  from  Xanthomonas campestris
atgccgagccccgtgactggtcgatgcattgagttagacgtgattgaacacgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcatgcgcatgcgtggttggtacgacatccaagggatggacttcccgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcacgcttgaatggcatagctacccgatgggccatcaagtgtgcgtagaggaaatcgatcatcttcgtgattggatgcaggctcgcttcaccgcggtt

SEQ ID NO: 36 - protein, 231 aa, Artificial Sequence
  Engineered Variants of Esterase  from  Xanthomonas campestris
MPSPVTGRCIELDVIEHETGPNPQWAVIWLHGLGADGSDFAPMVPELVRPQWPALRFVFPHAPIRPITIWNGMRMRGWYDIQGMDFPQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFTLEWHSYPMGHQVCVEEIDHLRDWMQARFTAV

SEQ ID NO: 37 - DNA, 693 bp, Artificial Sequence
  Engineered Variants of Esterase  from  Xanthomonas campestris
atgccgagccccgtgactggtcgatgcattatgttagacgtgattgaagtggaaaccggtccaaacccccaatgggccgtgatttggctgcatggcttgggtgctgatggttctgactttgcaccgatggttccggaactggtccgtccacaatggccatcgttacgcttcgtgtttcctcacgcgccgattcgtccgatcacgatctggaatggcctgcgcatgcgtggttggtacgacatccaagggatggacttcccgcaacgtgcggataaggtgggtattgcggagagtgttgcacaagttgaagccctgattgctcatgaaatggcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttccatcttgaatggcatagctacccgatgggccatcaagtgtgcgtagaggaaatcgatgcccttcgtgattggatgcaggctcgcttcaccgcggtt

SEQ ID NO: 38 - protein, 231 aa, Artificial Sequence
  Engineered Variants of Esterase  from  Xanthomonas campestris
MPSPVTGRCIMLDVIEVETGPNPQWAVIWLHGLGADGSDFAPMVPELVRPQWPSLRFVFPHAPIRPITIWNGLRMRGWYDIQGMDFPQRADKVGIAESVAQVEALIAHEMARGIAPDRILLAGFSQGGAVTLAVGLQRRVPLAGLIALSTYLPDPAAAASQLQPGALAQPLFMAHGSADLVVPYRAGEQSAQALQALGFHLEWHSYPMGHQVCVEEIDALRDWMQARFTAV

SEQ ID NO: 39 - DNA, 693 bp, Artificial Sequence
  Engineered Variants of Esterase  from  Xanthomonas campestris
atgccgagccccgtgactggtcgatgcattgagttagacgtgattgaacgtgaaaccggtccaaacccccaatgggccgtgatttggctgcatggcttgggtgctgatggttctgactttgcaccgatggttccggaactggtcagtccagactggccatcgttacgcttcgtgtttcctcacgcgccgattcgtccgatcacgatctggaatggcgtgcgcatgcgtggttggtacgacatccaagggatggacttcccgcaacgtgcggataaggtgggtattgcggagagtgttgcacaagttgaagccctgattgctcatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaagcattgcaagcattaggtttcacccttgaatggcatagctacccgatgggccatcaagtgtgcgtagaggaaatcgatgcccttcgtgattggatgcaggctcgcttcaccgcggtt

SEQ ID NO: 40 - protein, 231 aa, Artificial Sequence
  Engineered Variants of Esterase  from  Xanthomonas campestris
MPSPVTGRCIELDVIERETGPNPQWAVIWLHGLGADGSDFAPMVPELVSPDWPSLRFVFPHAPIRPITIWNGVRMRGWYDIQGMDFPQRADKVGIAESVAQVEALIAHEQARGIAPDRILLAGFSQGGAVTLAVGLQRRVPLAGLIAMSTYLPDPAAAASQLQPGALAQPLFMAHGSADLVVPYRAGEQSAQALQALGFTLEWHSYPMGHQVCVEEIDALRDWMQARFTAV

SEQ ID NO: 41 - DNA, 693 bp, Artificial Sequence
  Engineered Variants of Esterase  from  Xanthomonas campestris
atgccgagccccgtgactggtcgatgtattatgttagatgtgattgaagttgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatcgtggggatggacttcgcgcaacgtgcggataaggtgggtattgcggagagtgtagcacaagttgaaatgctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccgagcaactgcaaccgcaagcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcaccgcggtt

SEQ ID NO: 42 - protein, 231 aa, Artificial Sequence
  Engineered Variants of Esterase  from  Xanthomonas campestris
MPSPVTGRCIMLDVIEVETGPNPQWAVIWLHGLGADGSDFAPMVPELVRPQWPALRFVFPHAPIRPITIWNGVRMRGWYDIVGMDFAQRADKVGIAESVAQVEMLIANEQARGIAPDRILLAGFSQGGAVTLAVGLQRRVPLAGLIAMSTYLPDPAAAAEQLQPQALAQPLFMAHGSADPVVPYRAGEQSAQALQALGFTLEWHSYPMGHQVCVEEIDALRDWMQARFTAV

SEQ ID NO: 43 - DNA, 693 bp, Artificial Sequence
  Engineered Variants of Esterase  from  Xanthomonas campestris
atgccgagccccgtgactggtcgatgcattatgttagacgtgattgaacgtgaaaccggtccaaacccccaatgggccgtgatttggctgcatggcttgggtgctgatggttctgactttgcaccgatggttccggaactggtcagtccacagtggccagcgttacgcttcgtgtttcctcacgcgccgattcgtccgatcacgatctggaatggcctgcgcatgcgtggttggtacgacatcggggggatggacttcgcgcaacgtgcggataaggtgggtattgcggagagtgttgcacaagttgaagccctgattgctcacgaaatggcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcacgcttgaatggcatagctacccgatgggccatcaagtgtgcgtagaggaaatcgatgcccttcgtgattggatgtcggctcgcttcaccgcggtt

SEQ ID NO: 44 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVSPQWPALRFVFPHAPIRPITIWNGLRMRGWYDIGGMDFAQRADKVGIAESVAQVEALIAHEMARGIAPDRILLAGFSQGGAVTLAVGLQRRVPLAGLIALSTYLPDPAAAASQLQPGALAQPLFMAHGSADLVVPYRAGEQSAQALQALGFTLEWHSYPMGHQVCVEEIDALRDWMSARFTAV

SEQ ID NO: 45 - DNA, 693 bp, Artificial Sequence
  Engineered Variants of Esterase  from  Xanthomonas campestris
atgccgagccccgtgactggtcgatgcattatgttagacgtgattgaacgtgaaaccggtccaaacccccaatgggccgtgatttggctgcatggcttgggtgctgatggttctgactttgcaccgatggttccggaactggtccgtccagactggccagcgttacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcacgcttgaatggcatagctacccgatgggccatcaagtgtgcgtagaggaaatcgatcatcttcgtgattggatgcaggctcgcttcaccgcggtt

SEQ ID NO: 46 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPDWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFTLEWHSYPMGHQVCVEEIDHLRDWMQARFTAV

SEQ ID NO: 47 - DNA, 693 bp, Artificial Sequence
  Engineered Variants of Esterase  from  Xanthomonas campestris
atgccgagccccgtgactggtcgatgcattatgttagacgtgattgaacgtgaaaccggtccaaacccccaatgggccgtgatttggctgcatggcttgggtgctgatggttctgactttgcaccgatggttccggaactggtccgtccacaatggccatcgttacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcacgcttgaatggcatagctacccgatgggccatcaagtgtgcgtagaggaaatcgatgcacttcgtgattggatgcaggctcgcttcaccgcggtt

SEQ ID NO: 48 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPSLRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFTLEWHSYPMGHQVCVEEIDALRDWMQARFTAV

SEQ ID NO: 49 - DNA, 693 bp, Artificial Sequence
  Engineered Variants of Esterase  from  Xanthomonas campestris
atgccgagccccgtgactggtcgatgcattatgttagacgtgattgaacgtgaaaccggtccaaacccccaatgggccgtgatttggctgcatggcttgggtgctgatggttctgactttgcaccgatggttccggaactggtcagtccagactggccatcgttacgcttcgtgtttcctcacgcgccgattcgtccgatcacgatctggaatggcatgcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggctcgcttcaccgcggtt

SEQ ID NO: 50 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVSPDWPSLRFVFPHAPIRPITIWNGMRMRGWYDIQGMDFAQRADKVGIAESVAQVEALIANEQARGIAPDRILLAGFSQGGAVTLAVGLQRRVPLAGLIALSTYLPDPAAAASQLQPGALAQPLFMAHGSADLVVPYRAGEQSAQALQALGFTLEWHSYPMGHQVCVEEIDALRDWMQARFTAV

SEQ ID NO: 51 - DNA, 693 bp, Artificial Sequence
  Engineered Variants of Esterase  from  Xanthomonas campestris
atgccgagccccgtgactggtcgatgcattatgttagacgtgattgaacgtgaaaccggtccaaacccccaatgggccgtgatttggctgcatggcttgggtgctgatggttctgactttgcaccgatggttccggaactggtccgtccacaatggccatcgttacgcttcgtgtttcctcacgcgccgattcgtccgatcacgatctggaatggcgttcgcatgcgtggttggtacgacatccaagggatggacttcccgcaacgtgcggataaggtgggtattgcggagagtgttgcacaagttgaagccctgattgctcatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaagcattgcaagcattaggtttccatcttgaatggcatagctacccgatgggccatcaagtgtgcgtagaggaaatcgatgcccttcgtgattggatgcaggctcgcttcaccgcggtt

SEQ ID NO: 52 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPSLRFVFPHAPIRPITIWNGVRMRGWYDIQGMDFPQRADKVGIAESVAQVEALIAHEQARGIAPDRILLAGFSQGGAVTLAVGLQRRVPLAGLIAMSTYLPDPAAAASQLQPGALAQPLFMAHGSADLVVPYRAGEQSAQALQALGFHLEWHSYPMGHQVCVEEIDALRDWMQARFTAV

SEQ ID NO: 53 - DNA, 693 bp, Artificial Sequence
  Engineered Variants of Esterase  from  Xanthomonas campestris
atgccgagccccgtgactggtcgatgcattatgttagacgtgattgaagtggaaaccggtccaaacccccaatgggccgtgatttggctgcatggcttgggtgctgatggttctgactttgcaccgatggttccggaactggtcagtccacaatggccagcgttacgcttcgtgtttcctcacgcgccgattcgtccgatcacgatctggaatggcgtgcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcacaagcattgcaagcattaggtttcacgcttgaatggcatagctacccgatgggccatcaagtgtgcgtagaggaaatcgatgcacttcgtgattggatgcaggctcgcttcaccgcggtt

SEQ ID NO: 54 - protein, 231 aa, Artificial Sequence
  Engineered Variants of Esterase  from  Xanthomonas campestris
MPSPVTGRCIMLDVIEVETGPNPQWAVIWLHGLGADGSDFAPMVPELVSPQWPALRFVFPHAPIRPITIWNGVRMRGWYDIQGMDFAQRADKVGIAESVAQVEALIANEQARGIAPDRILLAGFSQGGAVTLAVGLQRRVPLAGLIALSTYLPDPAAAASQLQPGALAQPLFMAHGSADLVVPYRAGEQSAQALQALGFTLEWHSYPMGHQVCVEEIDALRDWMQARFTAV

SEQ ID NO: 55 - DNA, 693 bp, Artificial Sequence
  Engineered Variants of Esterase  from  Xanthomonas campestris
atgccgagccccgtgactggtcgatgcattatgttagacgtgattgaacacgaaaccggtccaaacccccaatgggccgtgatttggctgcatggcttgggtgctgatggttctgactttgcaccgatggttccggaactggtccgtccacaatggccatcgttacgcttcgtgtttcctcacgcgccgattcgtccgatcacgatctggaatggcgtgcgcatgcgtggttggtacgacatccaagggatggacttcccgcaacgtgcggataaggtgggtattgcggagagtgttgcacaagttgaagccctgattgctcatgaaatggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcacgcttgaatggcatagctacccgatgggccatcaagtgtgcgtagaggaaatcgatgcacttcgtgattggatgcaggctcgcttcaccgcggtt

SEQ ID NO: 56 - protein, 231 aa, Artificial Sequence
  Engineered Variants of Esterase  from  Xanthomonas campestris
MPSPVTGRCIMLDVIEHETGPNPQWAVIWLHGLGADGSDFAPMVPELVRPQWPSLRFVFPHAPIRPITIWNGVRMRGWYDIQGMDFPQRADKVGIAESVAQVEALIAHEMARGIAPDRILLAGFSQGGAVTLAVGLQRRVPLAGLIAMSTYLPDPAAAASQLQPGALAQPLFMAHGSADLVVPYRAGEQSAQALQALGFTLEWHSYPMGHQVCVEEIDALRDWMQARFTAV

SEQ ID NO: 57 - DNA, 693 bp, Artificial Sequence
  Engineered Variants of Esterase  from  Xanthomonas campestris
atgccgagccccgtgactggtcgatgcattatgttagacgtgattgaacgtgaaaccggtccaaacccccaatgggccgtgatttggctgcatggcttgggtgctgatggttctgactttgcaccgatggttccggaactggtccgtccacaatggccatcgttacgcttcgtgtttcctcacgcgccgattcgtccgatcacgatctggaatggcgttcgcatgcgtggttggtacgacatcggggggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggctcgcttcaccgcggtt

SEQ ID NO: 58 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPSLRFVFPHAPIRPITIWNGVRMRGWYDIGGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFTLEWHSYPMGHQVCVEEIDALRDWMQARFTAV

SEQ ID NO: 59 - DNA, 693 bp, Artificial Sequence
  Engineered Variants of Esterase  from  Xanthomonas campestris
atgccgagccccgtgactggtcgatgcattatgttagacgtgattgaacgtgaaaccggtccaaacccccaatgggccgtgatttggctgcatggcttgggtgctgatggttctgactttgcaccgatggttccggaactggtccgtccagactggccagcgttacgcttcgtgtttcctcacgcgccgattcgtccgatcacgatctggaatggcgttcgcatgcgtggttggtacgacatccaggggatggacttcgcgcaacgtgcggataaggtgggtattgcggagagtgttgcacaagttgaagccctgattgctaacgaaatggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttccatcttgaatggcatagctacccgatgggccatcaagtgtgcgtagaggaaatcgatgcccttcgtgattggatgcaagctcgcttcaccgcggtt

SEQ ID NO: 60 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPDWPALRFVFPHAPIRPITIWNGVRMRGWYDIQGMDFAQRADKVGIAESVAQVEALIANEMARGIAPDRILLAGFSQGGAVTLAVGLQRRVPLAGLIAMSTYLPDPAAAASQLQPGALAQPLFMAHGSADLVVPYRAGEQSAQALQALGFHLEWHSYPMGHQVCVEEIDALRDWMQARFTAV

SEQ ID NO: 61 - DNA, 693 bp, Artificial Sequence
  Engineered Variants of Esterase  from  Xanthomonas campestris
atgccgagccccgtgactggtcgagcgattatgttagatgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcgcgcttgaatggcatagctacccgatgggccatcaagtgtgctgggaggaaatcgatgcccttcgtgattggatgcaggcccgcttcaccgcggtt

SEQ ID NO: 62 - protein, 231 aa, Artificial Sequence
  Engineered Variants of Esterase  from  Xanthomonas campestris
MPSPVTGRAIMLDVIERETGPNPQWAVIWLHGLGADGSDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFALEWHSYPMGHQVCWEEIDALRDWMQARFTAV

SEQ ID NO: 63 - DNA, 693 bp, Artificial Sequence
  Engineered Variants of Esterase  from  Xanthomonas campestris
atgccgagccccgtgactggtcgatgcattatgttagacgtgattgaatgcgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcccgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcaatggcattgcaagcattaggtttcacccttgaatggcatagctacccgatgggccatcaagtgtgcgtagaggaaatcgatcatcttcgtgattggatgcaggctcgcttcaccgcggtt

SEQ ID NO: 64 - protein, 231 aa, Artificial Sequence
  Engineered Variants of Esterase  from  Xanthomonas campestris
MPSPVTGRCIMLDVIECETGPNPQWAVIWLHGLGADGSDFAPMVPELVRPQWPALRFVFPHAPIRPITIWNGVRMRGWYDIQGMDFPQRADKVGIAESVAQVEALIANEQARGIAPDRILLAGFSQGGAVTLAVGLQRRVPLAGLIALSTYLPDPAAAASQLQPGALAQPLFMAHGSADLVVPYRAGEQSAMALQALGFTLEWHSYPMGHQVCVEEIDHLRDWMQARFTAV

SEQ ID NO: 65 - DNA, 693 bp, Artificial Sequence
  Engineered Variants of Esterase  from  Xanthomonas campestris
atgccgagccccgtgactggtcgatgcattatgttagacgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcccgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcacccttgaatggcatagctacccgatgggccatcaagtgtgcgtagaggaaatcgatgcacttcgtgattggatgcaggctcgcttcaccgcggtt

SEQ ID NO: 66 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITIWNGVRMRGWYDIQGMDFPQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFTLEWHSYPMGHQVCVEEIDALRDWMQARFTAV

SEQ ID NO: 67 - DNA, 693 bp, Artificial Sequence
  Engineered Variants of Esterase  from  Xanthomonas campestris
atgccgagccccgtgactggtcgatgcattatgttagacgtgattgaacgcgaaaccggtccaaacccccaatgggccgtgatttggctgcatggcttgggtgctgatggttctgactttgcaccgatggttccggaactggtccgtccacaatggccagcgttacgcttcgtgtttcctcacgcgccgattcgtccgatcacgatctggaatggcatgcgcatgcgtggttggtacgacatccaagggatggacttcccgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttccatcttgaatggcatagctacccgatgggccatcaagtgtgcgtagaggaaatcgatgcacttcgtgattggatgcaggctcgcttcaccgcggtt

SEQ ID NO: 68 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITIWNGMRMRGWYDIQGMDFPQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFHLEWHSYPMGHQVCVEEIDALRDWMQARFTAV

SEQ ID NO: 69 - DNA, 693 bp, Artificial Sequence
  Engineered Variants of Esterase  from  Xanthomonas campestris
atgccgagccccgtgactggtcgatgcattatgctggacgtgattgaacgtgaaaccggtccaaacccccaatgggccgtgatttggctgcatggcttgggtgctgatggttctgactttgcaccgatggttccggaactggtccgtccagactggccatcgttacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcacgcttgaatggcatagctacccgatgggccatcaagtgtgcgtagaggaaatcgatgcccttcgtgattggatgcaagctcgcttcaccgcggtt

SEQ ID NO: 70 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPDWPSLRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFTLEWHSYPMGHQVCVEEIDALRDWMQARFTAV

SEQ ID NO: 71 - DNA, 693 bp, Artificial Sequence
  Engineered Variants of Esterase  from  Xanthomonas campestris
atgccgagccccgtgactggtcgatgcattatgttagacgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcccgcaacgtgcggataaggtgggtattgcggagagtgttgcacaagttgaagccctgattgctcatgaaatggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggctcgcttcaccgcggtt

SEQ ID NO: 72 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITIWNGVRMRGWYDIQGMDFPQRADKVGIAESVAQVEALIAHEMARGIAPDRILLAGFSQGGAVTLAVGLQRRVPLAGLIAMSTYLPDPAAAASQLQPGALAQPLFMAHGSADLVVPYRAGEQSAQALQALGFTLEWHSYPMGHQVCVEEIDALRDWMQARFTAV

SEQ ID NO: 73 - DNA, 693 bp, Artificial Sequence
  Engineered Variants of Esterase  from  Xanthomonas campestris
atgccgagccccgtgactggtcgatgcattatgttagacgtgattgaacgtgaaaccggtccaaacccccaatgggccgtgatttggctgcatggcttgggtgctgatggttctgactttgcaccgatggttccggaactggtcagtccacaatggccatcgttacgcttcgtgtttcctcacgcgccgattcgtccgatcacgatctggaatggcgttcgcatgcgtggttggtacgacatccaagggatggacttcccgcaacgtgcggataaggtgggtattgcggagagtgttgcacaagttgaagccctgattgctaatgaaatggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaagcattgcaagcattaggtttcacgcttgaatggcatagctacccgatgggccatcaagtgtgcgtagaggaaatcgatgcacttcgtgattggatgcaggctcgcttcaccgcggtt

SEQ ID NO: 74 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVSPQWPSLRFVFPHAPIRPITIWNGVRMRGWYDIQGMDFPQRADKVGIAESVAQVEALIANEMARGIAPDRILLAGFSQGGAVTLAVGLQRRVPLAGLIAMSTYLPDPAAAASQLQPGALAQPLFMAHGSADLVVPYRAGEQSAQALQALGFTLEWHSYPMGHQVCVEEIDALRDWMQARFTAV

SEQ ID NO: 75 - DNA, 693 bp, Artificial Sequence
  Engineered Variants of Esterase  from  Xanthomonas campestris
atgccgagccccgtgactggtcgatgcattgagttagacgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcatgcgcatgcgtggttggtacgacatccaagggatggacttcccgcaacgtgcggataaggtgggtattgcggagagtgttgcacaagttgaagccctgattgctaatgaaatggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaagcattgcaagcattaggtttcacccttgaatggcatagctacccgatgggccatcaagtgtgcgtagaggaaatcgatgcccttcgtgattggatgcaggctcgcttcaccgcggtt

SEQ ID NO: 76 - protein, 231 aa, Artificial Sequence
  Engineered Variants of Esterase  from  Xanthomonas campestris
MPSPVTGRCIELDVIERETGPNPQWAVIWLHGLGADGSDFAPMVPELVRPQWPALRFVFPHAPIRPITIWNGMRMRGWYDIQGMDFPQRADKVGIAESVAQVEALIANEMARGIAPDRILLAGFSQGGAVTLAVGLQRRVPLAGLIAMSTYLPDPAAAASQLQPGALAQPLFMAHGSADLVVPYRAGEQSAQALQALGFTLEWHSYPMGHQVCVEEIDALRDWMQARFTAV

SEQ ID NO: 77 - DNA, 693 bp, Artificial Sequence
  Engineered Variants of Esterase  from  Xanthomonas campestris
atgccgagccccgtgactggtcgatgcattatgttagacgtgattgaagtggaaaccggtccaaacccccaatgggccgtgatttggctgcatggcttgggtgctgatggttctgactttgcaccgatggttccggaactggtccgtccagactggccagcgttacgcttcgtgtttcctcacgcgccgattcgtccgatcacgatctggaatggcatgcgcatgcgtggttggtacgacatccaagggatggacttcccgcaacgtgcggataaggtgggtattgcggagagtgttgcacaagttgaagccctgattgctcatgaaatggcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcacgcttgaatggcatagctacccgatgggccatcaagtgtgcgtagaggaaatcgatcatcttcgtgattggatgcaggctcgcttcaccgcggtt

SEQ ID NO: 78 - protein, 231 aa, Artificial Sequence
  Engineered Variants of Esterase  from  Xanthomonas campestris
MPSPVTGRCIMLDVIEVETGPNPQWAVIWLHGLGADGSDFAPMVPELVRPDWPALRFVFPHAPIRPITIWNGMRMRGWYDIQGMDFPQRADKVGIAESVAQVEALIAHEMARGIAPDRILLAGFSQGGAVTLAVGLQRRVPLAGLIALSTYLPDPAAAASQLQPGALAQPLFMAHGSADLVVPYRAGEQSAQALQALGFTLEWHSYPMGHQVCVEEIDHLRDWMQARFTAV

SEQ ID NO: 79 - DNA, 693 bp, Artificial Sequence
  Engineered Variants of Esterase  from  Xanthomonas campestris
atgccgagccccgtgactggtcgatgcattatgttagacgtgattgaacgtgaaaccggtccaaacccccaatgggccgtgatttggctgcatggcttgggtgctgatggttctgactttgcaccgatggttccggaactggtcagtccagactggccagcgttacgcttcgtgtttcctcacgcgccgattcgtccgatcacgatctggaatggcgttcgcatgcgtggttggtacgacatccaggggatggacttcgcgcaacgtgcggataaggtgggtattgcggagagtgttgcacaagttgaagccctgattgctaacgaacaagcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcacccttgaatggcatagctacccgatgggccatcaagtgtgcgtagaggaaatcgatgcccttcgtgattggatgtcggctcgcttcaccgcggtt

SEQ ID NO: 80 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVSPDWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFTLEWHSYPMGHQVCVEEIDALRDWMSARFTAV

SEQ ID NO: 81 - DNA, 693 bp, Artificial Sequence
  Engineered Variants of Esterase  from  Xanthomonas campestris
atgccgagccccgtgactggtcgatgtattatgttagatgtgattgaacatgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcgcgcttgaatggcatagctacccgatgggccatcaagtgtgctgggaggaaatcgatgcccttcgtgattggatgcaggcccgcttcaccgcggtt

SEQ ID NO: 82 - protein, 231 aa, Artificial Sequence
  Engineered Variants of Esterase  from  Xanthomonas campestris
MPSPVTGRCIMLDVIEHETGPNPQWAVIWLHGLGADGSDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFALEWHSYPMGHQVCWEEIDALRDWMQARFTAV

SEQ ID NO: 83 - DNA, 693 bp, Artificial Sequence
  Engineered Variants of Esterase  from  Xanthomonas campestris
atgccgagccccgtgactggtcgatgcattatgttagacgtgattgaacgtgaaaccggtccaaacccccaatgggccgtgatttggctgcatggcttgggtgctgatggttctgactttgcaccgatggttccggaactggtccgtccagactggccagcgttacgcttcgtgtttcctcacgcgccgattcgtccgatcacgatctggaatggcgtgcgcatgcgtggttggtacgacatccaagggatggacttcgcgcaacgtgcggataaggtgggtattgcggagagtgttgcacaagttgaagccctgattgctcatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcacgcttgaatggcatagctacccgatgggccatcaagtgtgcgtagaggaaatcgatgcccttcgtgattggatgcaggctcgcttcaccgcggtt

SEQ ID NO: 84 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPDWPALRFVFPHAPIRPITIWNGVRMRGWYDIQGMDFAQRADKVGIAESVAQVEALIAHEQARGIAPDRILLAGFSQGGAVTLAVGLQRRVPLAGLIAMSTYLPDPAAAASQLQPGALAQPLFMAHGSADLVVPYRAGEQSAQALQALGFTLEWHSYPMGHQVCVEEIDALRDWMQARFTAV

SEQ ID NO: 85 - DNA, 693 bp, Artificial Sequence
  Engineered Variants of Esterase  from  Xanthomonas campestris
atgccgagccccgtgactggtcgatgcattatgttagacgtgattgaacacgaaaccggtccaaacccccaatgggccgtgatttggctgcatggcttgggtgctgatggttctgactttgcaccgatggttccggaactggtcagtccagactggccatcgttacgcttcgtgtttcctcacgcgccgattcgtccgatcacgatctggaatggcatgcgcatgcgtggttggtacgacatccaagggatggacttcgcgcaacgtgcggataaggtgggtattgcggagagtgttgcacaagttgaagccctgattgctcatgaaatggcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcaatggcattgcaagcattaggtttccatcttgaatggcatagctacccgatgggccatcaagtgtgcgtagaggaaatcgatcatcttcgtgattggatgcaggctcgcttcaccgcggtt

SEQ ID NO: 86 - protein, 231 aa, Artificial Sequence
  Engineered Variants of Esterase  from  Xanthomonas campestris
MPSPVTGRCIMLDVIEHETGPNPQWAVIWLHGLGADGSDFAPMVPELVSPDWPSLRFVFPHAPIRPITIWNGMRMRGWYDIQGMDFAQRADKVGIAESVAQVEALIAHEMARGIAPDRILLAGFSQGGAVTLAVGLQRRVPLAGLIALSTYLPDPAAAASQLQPGALAQPLFMAHGSADLVVPYRAGEQSAMALQALGFHLEWHSYPMGHQVCVEEIDHLRDWMQARFTAV

SEQ ID NO: 87 - DNA, 693 bp, Artificial Sequence
  Engineered Variants of Esterase  from  Xanthomonas campestris
atgccgagccccgtgactggtcgatgcattatgttagacgtgattgaacgtgaaaccggtccaaacccccaatgggccgtgatttggctgcatggcttgggtgctgatggttctgactttgcaccgatggttccggaactggtcagtccagactggccatcgttacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcaatggcattgcaagcattaggtttcacccttgaatggcatagctacccgatgggccatcaagtgtgcgtagaggaaatcgatgcccttcgtgattggatgcaggctcgcttcaccgcggtt

SEQ ID NO: 88 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVSPDWPSLRFVFPHAPIRPITIWNGVRMRGWYDIQGMDFAQRADKVGIAESVAQVEALIANEQARGIAPDRILLAGFSQGGAVTLAVGLQRRVPLAGLIALSTYLPDPAAAASQLQPGALAQPLFMAHGSADLVVPYRAGEQSAMALQALGFTLEWHSYPMGHQVCVEEIDALRDWMQARFTAV

SEQ ID NO: 89 - DNA, 693 bp, Artificial Sequence
  Engineered Variants of Esterase  from  Xanthomonas campestris
atgccgagccccgtgactggtcgatgcattatgttagacgtgattgaacgtgaaaccggtccaaacccccaatgggccgtgatttggctgcatggcttgggtgctgatggttctgactttgcaccgatggttccggaactggtcagtccacagtggccatcgttacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctcacgaacaagcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcacaagcattgcaagcattaggtttcacgcttgaatggcatagctacccgatgggccatcaagtgtgcgtagaggaaatcgatgcccttcgtgattggatgtcggctcgcttcaccgcggtt

SEQ ID NO: 90 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVSPQWPSLRFVFPHAPIRPITIWNGVRMRGWYDIQGMDFAQRADKVGIAESVAQVEALIAHEQARGIAPDRILLAGFSQGGAVTLAVGLQRRVPLAGLIALSTYLPDPAAAASQLQPGALAQPLFMAHGSADLVVPYRAGEQSAQALQALGFTLEWHSYPMGHQVCVEEIDALRDWMSARFTAV

SEQ ID NO: 91 - DNA, 693 bp, Artificial Sequence
  Engineered Variants of Esterase  from  Xanthomonas campestris
atgccgagccccgtgactggtcgatgcattatgttagacgtgattgaacgtgaaaccggtccaaacccccaatgggccgtgatttggctgcatggcttgggtgctgatggttctgactttgcaccgatggttccggaactggtccgtccacaatggccagcgttacgcttcgtgtttcctcacgcgccgattcgtccgatcacgatctggaatggcatgcgcatgcgtggttggtacgacatccaagggatggacttcccgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcaatggcattgcaagcattaggtttcacgcttgaatggcatagctacccgatgggccatcaagtgtgcgtagaggaaatcgatcatcttcgtgattggatgcaggctcgcttcaccgcggtt

SEQ ID NO: 92 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITIWNGMRMRGWYDIQGMDFPQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAMALQALGFTLEWHSYPMGHQVCVEEIDHLRDWMQARFTAV

SEQ ID NO: 93 - DNA, 693 bp, Artificial Sequence
  Engineered Variants of Esterase  from  Xanthomonas campestris
atgccgagccccgtgactggtcgatgcattatgttagacgtgattgaacgtgaaaccggtccaaacccccaatgggccgtgatttggctgcatggcttgggtgctgatggttctgactttgcaccgatggttccggaactggtccgtccacaatggccatcgttacgcttcgtgtttcctcacgcgccgattcgtccgatcacgatctggaatggcatgcgcatgcgtggttggtacgacatccaagggatggacttcgcgcaacgtgcggataaggtgggtattgcggagagtgttgcacaagttgaagccctgattgctcatgaacaggcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcaatggcattgcaagcattaggtttcacccttgaatggcatagctacccgatgggccatcaagtgtgcgtagaggaaatcgatgcccttcgtgattggatgcaggctcgcttcaccgcggtt

SEQ ID NO: 94 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPSLRFVFPHAPIRPITIWNGMRMRGWYDIQGMDFAQRADKVGIAESVAQVEALIAHEQARGIAPDRILLAGFSQGGAVTLAVGLQRRVPLAGLIALSTYLPDPAAAASQLQPGALAQPLFMAHGSADLVVPYRAGEQSAMALQALGFTLEWHSYPMGHQVCVEEIDALRDWMQARFTAV

SEQ ID NO: 95 - DNA, 693 bp, Artificial Sequence
  Engineered Variants of Esterase  from  Xanthomonas campestris
atgccgagccccgtgactggtcgacgcattgagccggacgtgattgaacgtgaaaccggtccaaacccccaatgggccgtgatttggctgcatggcttgggtgctgatggttctgactttgcaccgatggttccggaactggtccgtccagactggccatcgttacgcttcgtgtttcctcacgcgccgattcgtccgatcacgatctggaatggcctgcgcatgcgtggttggtacgacatccaggggatggacttcgcgcaacgtgcggataaggtgggtattgcggagagtgttgcacaagttgaagccctgattgctaacgaaatggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaagcattgcaagcattaggtttcacgcttgaatggcatagctacccgatgggccatcaagtgtgcgtagaggaaatcgatgcccttcgtgattggatgcaagctcgcttcaccgcggtt

SEQ ID NO: 96 - protein, 231 aa, Artificial Sequence
  Engineered Variants of Esterase  from  Xanthomonas campestris
MPSPVTGRRIEPDVIERETGPNPQWAVIWLHGLGADGSDFAPMVPELVRPDWPSLRFVFPHAPIRPITIWNGLRMRGWYDIQGMDFAQRADKVGIAESVAQVEALIANEMARGIAPDRILLAGFSQGGAVTLAVGLQRRVPLAGLIAMSTYLPDPAAAASQLQPGALAQPLFMAHGSADLVVPYRAGEQSAQALQALGFTLEWHSYPMGHQVCVEEIDALRDWMQARFTAV

SEQ ID NO: 97 - DNA, 693 bp, Artificial Sequence
  Engineered Variants of Esterase  from  Xanthomonas campestris
atgccgagccccgtgactggtcgatgcattatgttagacgtgattgaagtggaaaccggtccaaacccccaatgggccgtgatttggctgcatggcttgggtgctgatggttctgactttgcaccgatggttccggaactggtccgtccacaatggccatcgttacgcttcgtgtttcctcacgcgccgattcgtccgatcacgatctggaatggcctgcgcatgcgtggttggtacgacatccaagggatggacttcgcgcaacgtgcggataaggtgggtattgcggagagtgttgcacaagttgaagccctgattgctcatgaaatggcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcacaagcattgcaagcattaggtttcacgcttgaatggcatagctacccgatgggccatcaagtgtgcgtagaggaaatcgatgcccttcgtgattggatgcaggctcgcttcaccgcggtt

SEQ ID NO: 98 - protein, 231 aa, Artificial Sequence
  Engineered Variants of Esterase  from  Xanthomonas campestris
MPSPVTGRCIMLDVIEVETGPNPQWAVIWLHGLGADGSDFAPMVPELVRPQWPSLRFVFPHAPIRPITIWNGLRMRGWYDIQGMDFAQRADKVGIAESVAQVEALIAHEMARGIAPDRILLAGFSQGGAVTLAVGLQRRVPLAGLIALSTYLPDPAAAASQLQPGALAQPLFMAHGSADLVVPYRAGEQSAQALQALGFTLEWHSYPMGHQVCVEEIDALRDWMQARFTAV

SEQ ID NO: 99 - DNA, 693 bp, Artificial Sequence
  Engineered Variants of Esterase  from  Xanthomonas campestris
atgccgagccccgtgactggtcgatgcattgggttagacgtgattgaagtggaaaccggtccaaacccccaatgggccgtgatttggctgcatggcttgggtgctgatggttctgactttgcaccgatggttccggaactggtccgtccagactggccatcgttacgcttcgtgtttcctcacgcgccgattcgtccgatcacgatctggaatggcgtgcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttccatcttgaatggcatagctacccgatgggccatcaagtgtgcgtagaggaaatcgatgcacttcgtgattggatgcaggctcgcttcaccgcggtt

SEQ ID NO: 100 - protein, 231 aa, Artificial Sequence
  Engineered Variants of Esterase  from  Xanthomonas campestris
MPSPVTGRCIGLDVIEVETGPNPQWAVIWLHGLGADGSDFAPMVPELVRPDWPSLRFVFPHAPIRPITIWNGVRMRGWYDIQGMDFAQRADKVGIAESVAQVEALIANEQARGIAPDRILLAGFSQGGAVTLAVGLQRRVPLAGLIALSTYLPDPAAAASQLQPGALAQPLFMAHGSADLVVPYRAGEQSAQALQALGFHLEWHSYPMGHQVCVEEIDALRDWMQARFTAV

SEQ ID NO: 101 - DNA, 693 bp, Artificial Sequence
  Engineered Variants of Esterase  from  Xanthomonas campestris
atgccgagccccgtgactggtcgatgcattatgttagacgtgattgaacgtgaaaccggtccaaacccccaatgggccgtgatttggctgcatggcttgggtgctgatggttctgactttgcaccgatggttccggaactggtcagtccagactggccatcgttacgcttcgtgtttcctcacgcgccgattcgtccgatcacgatctggaatggcgtgcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggctcgcttcaccgcggtt

SEQ ID NO: 102 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVSPDWPSLRFVFPHAPIRPITIWNGVRMRGWYDIQGMDFAQRADKVGIAESVAQVEALIANEQARGIAPDRILLAGFSQGGAVTLAVGLQRRVPLAGLIALSTYLPDPAAAASQLQPGALAQPLFMAHGSADLVVPYRAGEQSAQALQALGFTLEWHSYPMGHQVCVEEIDALRDWMQARFTAV

SEQ ID NO: 103 - DNA, 693 bp, Artificial Sequence
  Engineered Variants of Esterase  from  Xanthomonas campestris
atgccgagccccgtgactggtcgatgcattatgttagacgtgattgaagtggaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaaatggcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttccatcttgaatggcatagctacccgatgggccatcaagtgtgcgtagaggaaatcgatgcacttcgtgattggatgcaggctcgcttcaccgcggtt

SEQ ID NO: 104 - protein, 231 aa, Artificial Sequence
  Engineered Variants of Esterase  from  Xanthomonas campestris
MPSPVTGRCIMLDVIEVETGPNPQWAVIWLHGLGADGSDFAPMVPELVRPQWPALRFVFPHAPIRPITIWNGVRMRGWYDIQGMDFAQRADKVGIAESVAQVEALIANEMARGIAPDRILLAGFSQGGAVTLAVGLQRRVPLAGLIALSTYLPDPAAAASQLQPGALAQPLFMAHGSADLVVPYRAGEQSAQALQALGFHLEWHSYPMGHQVCVEEIDALRDWMQARFTAV

SEQ ID NO: 105 - DNA, 693 bp, Artificial Sequence
  Engineered Variants of Esterase  from  Xanthomonas campestris
atgccgagccccgtgactggtcgatgcattatgttagacgtgattgaacgtgaaaccggtccaaacccccaatgggccgtgatttggctgcatggcttgggtgctgatggttctgactttgcaccgatggttccggaactggtccgtccagactggccatcgttacgcttcgtgtttcctcacgcgccgattcgtccgatcacgatctggaatggcgtgcgcatgcgtggttggtacgacatccaggggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttccatcttgaatggcatagctacccgatgggccatcaagtgtgcgtagaggaaatcgatgcccttcgtgattggatgcaagctcgcttcaccgcggtt

SEQ ID NO: 106 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPDWPSLRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFHLEWHSYPMGHQVCVEEIDALRDWMQARFTAV

SEQ ID NO: 107 - DNA, 693 bp, Artificial Sequence
  Engineered Variants of Esterase  from  Xanthomonas campestris
atgccgagccccgtgactggtcgatgcattatgttagacgtgattgaacgcgaaaccggtccaaacccccaatgggccgtgatttggctgcatggcttgggtgctgatggttctgactttgcaccgatggttccggaactggtcagtccacaatggccagcgttacgcttcgtgtttcctcacgcgccgattcgtccgatcacgatctggaatggcctgcgcatgcgtggttggtacgacatccaagggatggacttcccgcaacgtgcggataaggtgggtattgcggagagtgttgcacaagttgaagccctgattgctcatgaacaggcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcacaagcattgcaagcattaggtttcacgcttgaatggcatagctacccgatgggccatcaagtgtgcgtagaggaaatcgatgcacttcgtgattggatgcaggctcgcttcaccgcggtt

SEQ ID NO: 108 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVSPQWPALRFVFPHAPIRPITIWNGLRMRGWYDIQGMDFPQRADKVGIAESVAQVEALIAHEQARGIAPDRILLAGFSQGGAVTLAVGLQRRVPLAGLIALSTYLPDPAAAASQLQPGALAQPLFMAHGSADLVVPYRAGEQSAQALQALGFTLEWHSYPMGHQVCVEEIDALRDWMQARFTAV

SEQ ID NO: 109 - DNA, 693 bp, Artificial Sequence
  Engineered Variants of Esterase  from  Xanthomonas campestris
atgccgagccccgtgactggtcgatgcattatgttagacgtgattgaacgtgaaaccggtccaaacccccaatgggccgtgatttggctgcatggcttgggtgctgatggttctgactttgcaccgatggttccggaactggtcagtccacaatggccagcgttacgcttcgtgtttcctcacgcgccgattcgtccgatcacgatctggaatggcgtgcgcatgcgtggttggtacgacatccaagggatggacttcccgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcacccttgaatggcatagctacccgatgggccatcaagtgtgcgtagaggaaatcgatgcacttcgtgattggatgcaggctcgcttcaccgcggtt

SEQ ID NO: 110 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVSPQWPALRFVFPHAPIRPITIWNGVRMRGWYDIQGMDFPQRADKVGIAESVAQVEALIANEQARGIAPDRILLAGFSQGGAVTLAVGLQRRVPLAGLIALSTYLPDPAAAASQLQPGALAQPLFMAHGSADLVVPYRAGEQSAQALQALGFTLEWHSYPMGHQVCVEEIDALRDWMQARFTAV

SEQ ID NO: 111 - DNA, 693 bp, Artificial Sequence
  Engineered Variants of Esterase  from  Xanthomonas campestris
atgccgagccccgtgactggtcgatgcattatgttagacgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcctgcgcatgcgtggttggtacgacatccaagggatggacttcgcgcaacgtgcggataaggtgggtattgcggagagtgttgcacaagttgaagccctgattgctcatgaacaggcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcacgcttgaatggcatagctacccgatgggccatcaagtgtgcgtagaggaaatcgatgcccttcgtgattggatgcaggctcgcttcaccgcggtt

SEQ ID NO: 112 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITIWNGLRMRGWYDIQGMDFAQRADKVGIAESVAQVEALIAHEQARGIAPDRILLAGFSQGGAVTLAVGLQRRVPLAGLIALSTYLPDPAAAASQLQPGALAQPLFMAHGSADLVVPYRAGEQSAQALQALGFTLEWHSYPMGHQVCVEEIDALRDWMQARFTAV

SEQ ID NO: 113 - DNA, 693 bp, Artificial Sequence
  Engineered Variants of Esterase  from  Xanthomonas campestris
atgccgagccccgtgactggtcgatgcattatgttagacgtgattgaacgtgaaaccggtccaaacccccaatgggccgtgatttggctgcatggcttgggtgctgatggttctgactttgcaccgatggttccggaactggtcagtccacaatggccatcgttacgcttcgtgtttcctcacgcgccgattcgtccgatcacgatctggaatggcctgcgcatgcgtggttggtacgacatccaagggatggacttcccgcaacgtgcggataaggtgggtattgcggagagtgttgcacaagttgaagccctgattgctaatgaaatggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggctcgcttcaccgcggtt

SEQ ID NO: 114 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVSPQWPSLRFVFPHAPIRPITIWNGLRMRGWYDIQGMDFPQRADKVGIAESVAQVEALIANEMARGIAPDRILLAGFSQGGAVTLAVGLQRRVPLAGLIAMSTYLPDPAAAASQLQPGALAQPLFMAHGSADLVVPYRAGEQSAQALQALGFTLEWHSYPMGHQVCVEEIDALRDWMQARFTAV

SEQ ID NO: 115 - DNA, 693 bp, Artificial Sequence
  Engineered Variants of Esterase  from  Xanthomonas campestris
atgccgagccccgtgactggtcgatgcattatgttagacgtgattgaacgtgaaaccggtccaaacccccaatgggccgtgatttggctgcatggcttgggtgctgatggttctgactttgcaccgatggttccggaactggtccgtccacaatggccagcgttacgcttcgtgtttcctcacgcgccgattcgtccgatcacgatctggaatggcatgcgcatgcgtggttggtacgacatccaagggatggacttcgcgcaacgtgcggataaggtgggtattgcggagagtgttgcacaagttgaagccctgattgctcatgaacaggcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcaatggcattgcaagcattaggtttcacccttgaatggcatagctacccgatgggccatcaagtgtgcgtagaggaaatcgatcatcttcgtgattggatgcaggctcgcttcaccgcggtt

SEQ ID NO: 116 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITIWNGMRMRGWYDIQGMDFAQRADKVGIAESVAQVEALIAHEQARGIAPDRILLAGFSQGGAVTLAVGLQRRVPLAGLIALSTYLPDPAAAASQLQPGALAQPLFMAHGSADLVVPYRAGEQSAMALQALGFTLEWHSYPMGHQVCVEEIDHLRDWMQARFTAV

SEQ ID NO: 117 - DNA, 693 bp, Artificial Sequence
  Engineered Variants of Esterase  from  Xanthomonas campestris
atgccgagccccgtgactggtcgatgcattatgttagacgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcctgcgcatgcgtggttggtacgacatccaagggatggacttcgcgcaacgtgcggataaggtgggtattgcggagagtgttgcacaagttgaagccctgattgctcatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaagcattgcaagcattaggtttcacccttgaatggcatagctacccgatgggccatcaagtgtgcgtagaggaaatcgatgcacttcgtgattggatgcaggctcgcttcaccgcggtt

SEQ ID NO: 118 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITIWNGLRMRGWYDIQGMDFAQRADKVGIAESVAQVEALIAHEQARGIAPDRILLAGFSQGGAVTLAVGLQRRVPLAGLIAMSTYLPDPAAAASQLQPGALAQPLFMAHGSADLVVPYRAGEQSAQALQALGFTLEWHSYPMGHQVCVEEIDALRDWMQARFTAV

SEQ ID NO: 119 - DNA, 693 bp, Artificial Sequence
  Engineered Variants of Esterase  from  Xanthomonas campestris
atgccgagccccgtgactggtcgatgcattatgttagacgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcccgcaacgtgcggataaggtgggtattgcggagagtgttgcacaagttgaagccctgattgctcatgaaatggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcaatggcattgcaagcattaggtttcacccttgaatggcatagctacccgatgggccatcaagtgtgcgtagaggaaatcgatgcacttcgtgattggatgcaggctcgcttcaccgcggtt

SEQ ID NO: 120 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITIWNGVRMRGWYDIQGMDFPQRADKVGIAESVAQVEALIAHEMARGIAPDRILLAGFSQGGAVTLAVGLQRRVPLAGLIAMSTYLPDPAAAASQLQPGALAQPLFMAHGSADLVVPYRAGEQSAMALQALGFTLEWHSYPMGHQVCVEEIDALRDWMQARFTAV

SEQ ID NO: 121 - DNA, 693 bp, Artificial Sequence
  Engineered Variants of Esterase  from  Xanthomonas campestris
atgccgagccccgtgactggtcgatgcattatgttagacgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcatgcgcatgcgtggttggtacgacatccaagggatggacttcgcgcaacgtgcggataaggtgggtattgcggagagtgttgcacaagttgaagccctgattgctcatgaaatggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaagcattgcaagcattaggtttccatcttgaatggcatagctacccgatgggccatcaagtgtgcgtagaggaaatcgatcatcttcgtgattggatgcaggctcgcttcaccgcggtt

SEQ ID NO: 122 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITIWNGMRMRGWYDIQGMDFAQRADKVGIAESVAQVEALIAHEMARGIAPDRILLAGFSQGGAVTLAVGLQRRVPLAGLIAMSTYLPDPAAAASQLQPGALAQPLFMAHGSADLVVPYRAGEQSAQALQALGFHLEWHSYPMGHQVCVEEIDHLRDWMQARFTAV

SEQ ID NO: 123 - DNA, 693 bp, Artificial Sequence
  Engineered Variants of Esterase  from  Xanthomonas campestris
atgccgagccccgtgactggtcgatgcattatgttagacgtgattgaacgtgaaaccggtccaaacccccaatgggccgtgatttggctgcatggcttgggtgctgatggttctgactttgcaccgatggttccggaactggtccgtccacagtggccagcgttacgcttcgtgtttcctcacgcgccgattcgtccgatcacgatctggaatggcatgcgcatgcgtggttggtacgacatccaagggatggacttcgcgcaacgtgcggataaggtgggtattgcggagagtgttgcacaagttgaagccctgattgctcacgaacaagcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcacaagcattgcaagcattaggtttcacccttgaatggcatagctacccgatgggccatcaagtgtgcgtagaggaaatcgatgcccttcgtgattggatgcaagctcgcttcaccgcggtt

SEQ ID NO: 124 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITIWNGMRMRGWYDIQGMDFAQRADKVGIAESVAQVEALIAHEQARGIAPDRILLAGFSQGGAVTLAVGLQRRVPLAGLIALSTYLPDPAAAASQLQPGALAQPLFMAHGSADLVVPYRAGEQSAQALQALGFTLEWHSYPMGHQVCVEEIDALRDWMQARFTAV

SEQ ID NO: 125 - DNA, 693 bp, Artificial Sequence
  Engineered Variants of Esterase  from  Xanthomonas campestris
atgccgagccccgtgactggtcgatgcattatgttagacgtgattgaacgtgaaaccggtccaaacccccaatgggccgtgatttggctgcatggcttgggtgctgatggttctgactttgcaccgatggttccggaactggtccgtccacaatggccagcgttacgcttcgtgtttcctcacgcgccgattcgtccgatcacgatctggaatggcatgcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcacaagcattgcaagcattaggtttcacccttgaatggcatagctacccgatgggccatcaagtgtgcgtagaggaaatcgatgcccttcgtgattggatgcaggctcgcttcaccgcggtt

SEQ ID NO: 126 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITIWNGMRMRGWYDIQGMDFAQRADKVGIAESVAQVEALIANEQARGIAPDRILLAGFSQGGAVTLAVGLQRRVPLAGLIALSTYLPDPAAAASQLQPGALAQPLFMAHGSADLVVPYRAGEQSAQALQALGFTLEWHSYPMGHQVCVEEIDALRDWMQARFTAV

SEQ ID NO: 127 - DNA, 693 bp, Artificial Sequence
  Engineered Variants of Esterase  from  Xanthomonas campestris
atgccgagccccgtgactggtcgatgcattgagttagacgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcatgcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcacgcttgaatggcatagctacccgatgggccatcaagtgtgcgtagaggaaatcgatgcacttcgtgattggatgcaggctcgcttcaccgcggtt

SEQ ID NO: 128 - protein, 231 aa, Artificial Sequence
  Engineered Variants of Esterase  from  Xanthomonas campestris
MPSPVTGRCIELDVIERETGPNPQWAVIWLHGLGADGSDFAPMVPELVRPQWPALRFVFPHAPIRPITIWNGMRMRGWYDIQGMDFAQRADKVGIAESVAQVEALIANEQARGIAPDRILLAGFSQGGAVTLAVGLQRRVPLAGLIALSTYLPDPAAAASQLQPGALAQPLFMAHGSADLVVPYRAGEQSAQALQALGFTLEWHSYPMGHQVCVEEIDALRDWMQARFTAV

SEQ ID NO: 129 - DNA, 693 bp, Artificial Sequence
  Engineered Variants of Esterase  from  Xanthomonas campestris
atgccgagccccgtgactggtcgatgcattgagttagacgtgattgaacgtgaaaccggtccaaacccccaatgggccgtgatttggctgcatggcttgggtgctgatggttctgactttgcaccgatggttccggaactggtccgtccacaatggccagcgttacgcttcgtgtttcctcacgcgccgattcgtccgatcacgatctggaatggcctgcgcatgcgtggttggtacgacatccaagggatggacttcgcgcaacgtgcggataaggtgggtattgcggagagtgttgcacaagttgaagccctgattgctcatgaacaggcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcacccttgaatggcatagctacccgatgggccatcaagtgtgcgtagaggaaatcgatgcacttcgtgattggatgcaggctcgcttcaccgcggtt

SEQ ID NO: 130 - protein, 231 aa, Artificial Sequence
  Engineered Variants of Esterase  from  Xanthomonas campestris
MPSPVTGRCIELDVIERETGPNPQWAVIWLHGLGADGSDFAPMVPELVRPQWPALRFVFPHAPIRPITIWNGLRMRGWYDIQGMDFAQRADKVGIAESVAQVEALIAHEQARGIAPDRILLAGFSQGGAVTLAVGLQRRVPLAGLIALSTYLPDPAAAASQLQPGALAQPLFMAHGSADLVVPYRAGEQSAQALQALGFTLEWHSYPMGHQVCVEEIDALRDWMQARFTAV

SEQ ID NO: 131 - DNA, 693 bp, Artificial Sequence
  Engineered Variants of Esterase  from  Xanthomonas campestris
atgccgagccccgtgactggtcgatgcattgagttagacgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcctgcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcacaagcattgcaagcattaggtttcacccttgaatggcatagctacccgatgggccatcaagtgtgcgtagaggaaatcgatgcacttcgtgattggatgcaggctcgcttcaccgcggtt

SEQ ID NO: 132 - protein, 231 aa, Artificial Sequence
  Engineered Variants of Esterase  from  Xanthomonas campestris
MPSPVTGRCIELDVIERETGPNPQWAVIWLHGLGADGSDFAPMVPELVRPQWPALRFVFPHAPIRPITIWNGLRMRGWYDIQGMDFAQRADKVGIAESVAQVEALIANEQARGIAPDRILLAGFSQGGAVTLAVGLQRRVPLAGLIALSTYLPDPAAAASQLQPGALAQPLFMAHGSADLVVPYRAGEQSAQALQALGFTLEWHSYPMGHQVCVEEIDALRDWMQARFTAV

SEQ ID NO: 133 - DNA, 693 bp, Artificial Sequence
  Engineered Variants of Esterase  from  Xanthomonas campestris
atgccgagccccgtgactggtcgatgcattatcttagacgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcttgcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcgcgcttgaatggcatagctacccgatgggccatcaagtgtgctgggaggaaatcgatgcccttcgtgattggatgcaggcccgcttcaccgcggtt

SEQ ID NO: 134 - protein, 231 aa, Artificial Sequence
  Engineered Variants of Esterase  from  Xanthomonas campestris
MPSPVTGRCIILDVIERETGPNPQWAVIWLHGLGADGSDFAPMVPELVRPQWPALRFVFPHAPIRPITIWNGLRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFALEWHSYPMGHQVCWEEIDALRDWMQARFTAV

SEQ ID NO: 135 - DNA, 693 bp, Artificial Sequence
  Engineered Variants of Esterase  from  Xanthomonas campestris
atgccgagccccgtgactggtcgatgcattatgttagacgtgattgaatgcgaaaccggtccaaacccccaatgggccgtgatttggctgcatggcttgggtgctgatggttctgactttgcaccgatggttccggaactggtccgtccacaatggccagcgttacgcttcgtgtttcctcacgcgccgattcgtccgatcacgatctggaatggcctgcgcatgcgtggttggtacgacatccaagggatggacttcgcgcaacgtgcggataaggtgggtattgcggagagtgttgcacaagttgaagccctgattgctcatgaaatggcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttccatcttgaatggcatagctacccgatgggccatcaagtgtgcgtagaggaaatcgatgcccttcgtgattggatgcaggctcgcttcaccgcggtt

SEQ ID NO: 136 - protein, 231 aa, Artificial Sequence
  Engineered Variants of Esterase  from  Xanthomonas campestris
MPSPVTGRCIMLDVIECETGPNPQWAVIWLHGLGADGSDFAPMVPELVRPQWPALRFVFPHAPIRPITIWNGLRMRGWYDIQGMDFAQRADKVGIAESVAQVEALIAHEMARGIAPDRILLAGFSQGGAVTLAVGLQRRVPLAGLIALSTYLPDPAAAASQLQPGALAQPLFMAHGSADLVVPYRAGEQSAQALQALGFHLEWHSYPMGHQVCVEEIDALRDWMQARFTAV

SEQ ID NO: 137 - DNA, 693 bp, Artificial Sequence
  Engineered Variants of Esterase  from  Xanthomonas campestris
atgccgagccccgtgactggtcgatgcattatgttagacgtgattgaacgtgaaaccggtccaaacccccaatgggccgtgatttggctgcatggcttgggtgctgatggttctgactttgcaccgatggttccggaactggtcagtccagactggccagcgttacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaaatggcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcacgcttgaatggcatagctacccgatgggccatcaagtgtgcgtagaggaaatcgatgcccttcgtgattggatgcaggctcgcttcaccgcggtt

SEQ ID NO: 138 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVSPDWPALRFVFPHAPIRPITIWNGVRMRGWYDIQGMDFAQRADKVGIAESVAQVEALIANEMARGIAPDRILLAGFSQGGAVTLAVGLQRRVPLAGLIALSTYLPDPAAAASQLQPGALAQPLFMAHGSADLVVPYRAGEQSAQALQALGFTLEWHSYPMGHQVCVEEIDALRDWMQARFTAV

SEQ ID NO: 139 - DNA, 693 bp, Artificial Sequence
  Engineered Variants of Esterase  from  Xanthomonas campestris
atgccgagccccgtgactggtcgatgtattatgttagatgtgattgaatgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcgcgcttgaatggcatagctacccgatgggccatcaagtgtgctgggaggaaatcgatgcccttcgtgattggatgcaggcccgcttcaccgcggtt

SEQ ID NO: 140 - protein, 231 aa, Artificial Sequence
  Engineered Variants of Esterase  from  Xanthomonas campestris
MPSPVTGRCIMLDVIECETGPNPQWAVIWLHGLGADGSDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFALEWHSYPMGHQVCWEEIDALRDWMQARFTAV

SEQ ID NO: 141 - DNA, 693 bp, Artificial Sequence
  Engineered Variants of Esterase  from  Xanthomonas campestris
atgccgagccccgtgactggtcgatgcattatgttagacgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcctgcgcatgcgtggttggtacgacatccaagggatggacttcgcgcaacgtgcggataaggtgggtattgcggagagtgttgcacaagttgaagccctgattgctcatgaacaggcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcaatggcattgcaagcattaggtttcacccttgaatggcatagctacccgatgggccatcaagtgtgcgtagaggaaatcgatgcacttcgtgattggatgcaggctcgcttcaccgcggtt

SEQ ID NO: 142 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITIWNGLRMRGWYDIQGMDFAQRADKVGIAESVAQVEALIAHEQARGIAPDRILLAGFSQGGAVTLAVGLQRRVPLAGLIALSTYLPDPAAAASQLQPGALAQPLFMAHGSADLVVPYRAGEQSAMALQALGFTLEWHSYPMGHQVCVEEIDALRDWMQARFTAV

SEQ ID NO: 143 - DNA, 693 bp, Artificial Sequence
  Engineered Variants of Esterase  from  Xanthomonas campestris
atgccgagccccgtgactggtcgatgcattatgccggacgtgattgaacgtgaaaccggtccaaacccccaatgggccgtgatttggctgcatggcttgggtgctgatggttctgactttgcaccgatggttccggaactggtcagtccagactggccatcgttacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctcacgaacaagcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcacccttgaatggcatagctacccgatgggccatcaagtgtgcgtagaggaaatcgatgcccttcgtgattggatgtcggctcgcttcaccgcggtt

SEQ ID NO: 144 - protein, 231 aa, Artificial Sequence
  Engineered Variants of Esterase  from  Xanthomonas campestris
MPSPVTGRCIMPDVIERETGPNPQWAVIWLHGLGADGSDFAPMVPELVSPDWPSLRFVFPHAPIRPITIWNGVRMRGWYDIQGMDFAQRADKVGIAESVAQVEALIAHEQARGIAPDRILLAGFSQGGAVTLAVGLQRRVPLAGLIALSTYLPDPAAAASQLQPGALAQPLFMAHGSADLVVPYRAGEQSAQALQALGFTLEWHSYPMGHQVCVEEIDALRDWMSARFTAV

SEQ ID NO: 145 - DNA, 693 bp, Artificial Sequence
  Engineered Variants of Esterase  from  Xanthomonas campestris
atgccgagccccgtgactggtcgatgcattatcttagacgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatcgtgaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcgcgcttgaatggcatagctacccgatgggccatcaagtgtgctgggaggaaatcgatgcccttcgtgattggatgcaggcccgcttcaccgcggtt

SEQ ID NO: 146 - protein, 231 aa, Artificial Sequence
  Engineered Variants of Esterase  from  Xanthomonas campestris
MPSPVTGRCIILDVIERETGPNPQWAVIWLHGLGADGSDFAPMVPELVRPQWPALRFVFPHAPIRPITIVNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFALEWHSYPMGHQVCWEEIDALRDWMQARFTAV

SEQ ID NO: 147 - DNA, 693 bp, Artificial Sequence
  Engineered Variants of Esterase  from  Xanthomonas campestris
atgccgagccccgtgactggtcgatgcattgagttagacgtgattgaacgtgaaaccggtccaaacccccaatgggccgtgatttggctgcatggcttgggtgctgatggttctgactttgcaccgatggttccggaactggtcagtccacaatggccagcattacgcttcgtgtttcctcacgcgccgattcgtccgatcacgatctggaatggcgtgcgcatgcgtggttggtacgacatccaagggatggacttcccgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcacgcttgaatggcatagctacccgatgggccatcaagtgtgcgtagaggaaatcgatgcccttcgtgattggatgcaggctcgcttcaccgcggtt

SEQ ID NO: 148 - protein, 231 aa, Artificial Sequence
  Engineered Variants of Esterase  from  Xanthomonas campestris
MPSPVTGRCIELDVIERETGPNPQWAVIWLHGLGADGSDFAPMVPELVSPQWPALRFVFPHAPIRPITIWNGVRMRGWYDIQGMDFPQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFTLEWHSYPMGHQVCVEEIDALRDWMQARFTAV

SEQ ID NO: 149 - DNA, 693 bp, Artificial Sequence
  Engineered Variants of Esterase  from  Xanthomonas campestris
atgccgagccccgtgactggtcgatgcattatgttagacgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcctgcgcatgcgtggttggtacgacatccaagggatggacttcccgcaacgtgcggataaggtgggtattgcggagagtgttgcacaagttgaagccctgattgctcatgaaatggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaagcattgcaagcattaggtttcacgcttgaatggcatagctacccgatgggccatcaagtgtgcgtagaggaaatcgatgcacttcgtgattggatgcaggctcgcttcaccgcggtt

SEQ ID NO: 150 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITIWNGLRMRGWYDIQGMDFPQRADKVGIAESVAQVEALIAHEMARGIAPDRILLAGFSQGGAVTLAVGLQRRVPLAGLIAMSTYLPDPAAAASQLQPGALAQPLFMAHGSADLVVPYRAGEQSAQALQALGFTLEWHSYPMGHQVCVEEIDALRDWMQARFTAV

SEQ ID NO: 151 - DNA, 693 bp, Artificial Sequence
  Engineered Variants of Esterase  from  Xanthomonas campestris
atgccgagccccgtgactggtcgatgcattgggttagacgtgattgaacgtgaaaccggtccaaacccccaatgggccgtgatttggctgcatggcttgggtgctgatggttctgactttgcaccgatggttccggaactggtccgtccagactggccatcgttacgcttcgtgtttcctcacgcgccgattcgtccgatcacgatctggaatggcctgcgcatgcgtggttggtacgacatccaagggatggacttcgcgcaacgtgcggataaggtgggtattgcggagagtgttgcacaagttgaagccctgattgctcatgaaatggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcacgcttgaatggcatagctacccgatgggccatcaagtgtgcgtagaggaaatcgatgcacttcgtgattggatgcaggctcgcttcaccgcggtt

SEQ ID NO: 152 - protein, 231 aa, Artificial Sequence
  Engineered Variants of Esterase  from  Xanthomonas campestris
MPSPVTGRCIGLDVIERETGPNPQWAVIWLHGLGADGSDFAPMVPELVRPDWPSLRFVFPHAPIRPITIWNGLRMRGWYDIQGMDFAQRADKVGIAESVAQVEALIAHEMARGIAPDRILLAGFSQGGAVTLAVGLQRRVPLAGLIAMSTYLPDPAAAASQLQPGALAQPLFMAHGSADLVVPYRAGEQSAQALQALGFTLEWHSYPMGHQVCVEEIDALRDWMQARFTAV

SEQ ID NO: 153 - DNA, 693 bp, Artificial Sequence
  Engineered Variants of Esterase  from  Xanthomonas campestris
atgccgagccccgtgactggtcgatgcattatcttagacgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcatgcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcgcgcttgaatggcatagctacccgatgggccatcaagtgtgctgggaggaaatcgatgcccttcgtgattggatgcaggcccgcttcaccgcggtt

SEQ ID NO: 154 - protein, 231 aa, Artificial Sequence
  Engineered Variants of Esterase  from  Xanthomonas campestris
MPSPVTGRCIILDVIERETGPNPQWAVIWLHGLGADGSDFAPMVPELVRPQWPALRFVFPHAPIRPITIWNGMRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFALEWHSYPMGHQVCWEEIDALRDWMQARFTAV

SEQ ID NO: 155 - DNA, 693 bp, Artificial Sequence
  Engineered Variants of Esterase  from  Xanthomonas campestris
atgccgagccccgtgactggtcgatgcattatgttagacgtgattgaagtggaaaccggtccaaacccccaatgggccgtgatttggctgcatggcttgggtgctgatggttctgactttgcaccgatggttccggaactggtccgtccacaatggccagcgttacgcttcgtgtttcctcacgcgccgattcgtccgatcacgatctggaatggcgttcgcatgcgtggttggtacgacatccaagggatggacttcccgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcacccttgaatggcatagctacccgatgggccatcaagtgtgcgtagaggaaatcgatgcacttcgtgattggatgcaggctcgcttcaccgcggtt

SEQ ID NO: 156 - protein, 231 aa, Artificial Sequence
  Engineered Variants of Esterase  from  Xanthomonas campestris
MPSPVTGRCIMLDVIEVETGPNPQWAVIWLHGLGADGSDFAPMVPELVRPQWPALRFVFPHAPIRPITIWNGVRMRGWYDIQGMDFPQRADKVGIAESVAQVEALIANEQARGIAPDRILLAGFSQGGAVTLAVGLQRRVPLAGLIALSTYLPDPAAAASQLQPGALAQPLFMAHGSADLVVPYRAGEQSAQALQALGFTLEWHSYPMGHQVCVEEIDALRDWMQARFTAV

SEQ ID NO: 157 - DNA, 693 bp, Artificial Sequence
  Engineered Variants of Esterase  from  Xanthomonas campestris
atgccgagccccgtgactggtcgatgcattgagttagacgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcatgcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcaatggcattgcaagcattaggtttccatcttgaatggcatagctacccgatgggccatcaagtgtgcgtagaggaaatcgatgcccttcgtgattggatgcaggctcgcttcaccgcggtt

SEQ ID NO: 158 - protein, 231 aa, Artificial Sequence
  Engineered Variants of Esterase  from  Xanthomonas campestris
MPSPVTGRCIELDVIERETGPNPQWAVIWLHGLGADGSDFAPMVPELVRPQWPALRFVFPHAPIRPITIWNGMRMRGWYDIQGMDFAQRADKVGIAESVAQVEALIANEQARGIAPDRILLAGFSQGGAVTLAVGLQRRVPLAGLIALSTYLPDPAAAASQLQPGALAQPLFMAHGSADLVVPYRAGEQSAMALQALGFHLEWHSYPMGHQVCVEEIDALRDWMQARFTAV

SEQ ID NO: 159 - DNA, 693 bp, Artificial Sequence
  Engineered Variants of Esterase  from  Xanthomonas campestris
atgccgagccccgtgactggtcgaactattaggccggacgtgattgaacgtgaaaccggtccaaacccccaatgggccgtgatttggctgcatggcttgggtgctgatggttctgactttgcaccgatggttccggaactggtccgtccagactggccatcgttacgcttcgtgtttcctcacgcgccgattcgtccgatcacgatctggaatggcctgcgcatgcgtggttggtacgacatccaagggatggacttcgcgcaacgtgcggataaggtgggtattgcggagagtgttgcacaagttgaagccctgattgctcacgaacaagcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcacaagcattgcaagcattaggtttcacgcttgaatggcatagctacccgatgggccatcaagtgtgcgtagaggaaatcgatgcccttcgtgattggatgtcggctcgcttcaccgcggtt

SEQ ID NO: 160 - protein, 231 aa, Artificial Sequence
  Engineered Variants of Esterase  from  Xanthomonas campestris
MPSPVTGRTIRPDVIERETGPNPQWAVIWLHGLGADGSDFAPMVPELVRPDWPSLRFVFPHAPIRPITIWNGLRMRGWYDIQGMDFAQRADKVGIAESVAQVEALIAHEQARGIAPDRILLAGFSQGGAVTLAVGLQRRVPLAGLIALSTYLPDPAAAASQLQPGALAQPLFMAHGSADLVVPYRAGEQSAQALQALGFTLEWHSYPMGHQVCVEEIDALRDWMSARFTAV

SEQ ID NO: 161 - DNA, 693 bp, Artificial Sequence
  Engineered Variants of Esterase  from  Xanthomonas campestris
atgccgagccccgtgactggtcgatgtattatgttagatgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatcaacaatggcgttcgcatgcgtggttggtacgacatcgtggggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggaggacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcaccgcggtt

SEQ ID NO: 162 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITINNGVRMRGWYDIVGMDFAQRADKVGIAESVAQVEALIANEQARGIAPDRILLAGFSQGGAVTLAVGLQRRVPLAGLIAMSTYLPDPAAAASQLQPGALAQPLFMAHGSEDPVVPYRAGEQSAQALQALGFTLEWHSYPMGHQVCVEEIDALRDWMQARFTAV

SEQ ID NO: 163 - DNA, 693 bp, Artificial Sequence
  Engineered Variants of Esterase  from  Xanthomonas campestris
atgccgagccccgtgactggtcgatgtattatgttagatgtgattgaacgggaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcgcgcttgaatggcatagctacccgatgggccatcaagtgtgctgggaggaaatcgatgcccttcgtgattggatgcaggcccgcttcaccgcggtt

SEQ ID NO: 164 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFALEWHSYPMGHQVCWEEIDALRDWMQARFTAV

SEQ ID NO: 165 - DNA, 693 bp, Artificial Sequence
  Engineered Variants of Esterase  from  Xanthomonas campestris
atgccgcgccccgtgactggtcgctgtattacgttagatgtgattgaacgtgaaaccgggccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgatttttaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcacggcggtt

SEQ ID NO: 166 - protein, 231 aa, Artificial Sequence
  Engineered Variants of Esterase  from  Xanthomonas campestris
MPRPVTGRCITLDVIERETGPNPQWAVIWLHGLGADGSDFAPMVPELVRPQWPALRFVFPHAPIRPITIWNGVRMRGWYDIQGMDFAQRADKVGIAESVAQVEALIFNEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFTAV

SEQ ID NO: 167 - DNA, 693 bp, Artificial Sequence
  Engineered Variants of Esterase  from  Xanthomonas campestris
atgccgagccccgtgactggtcgatgcattatgttagacgtgattgaacgtgaaaccggtccaaacccccaatgggccgtgatttggctgcatggcttgggtgctgatggttctgactttgcaccgatggttccggaactggtcagtccagactggccatcgttacgcttcgtgtttcctcacgcgccgattcgtccgatcacgatctggaatggcgtgcgcatgcgtggttggtacgacatcggggggatggacttcgcgcaacgtgcggataaggtgggtattgcggagagtgttgcacaagttgaagccctgattgctcacgaaatggcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcacgcttgaatggcatagctacccgatgggccatcaagtgtgcgtagaggaaatcgatgcccttcgtgattggatgtcggctcgcttcaccgcggtt

SEQ ID NO: 168 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVSPDWPSLRFVFPHAPIRPITIWNGVRMRGWYDIGGMDFAQRADKVGIAESVAQVEALIAHEMARGIAPDRILLAGFSQGGAVTLAVGLQRRVPLAGLIALSTYLPDPAAAASQLQPGALAQPLFMAHGSADLVVPYRAGEQSAQALQALGFTLEWHSYPMGHQVCVEEIDALRDWMSARFTAV

SEQ ID NO: 169 - DNA, 693 bp, Artificial Sequence
  Engineered Variants of Esterase  from  Xanthomonas campestris
atgccgagccccgtgactggtcgatgcattgggttagacgtgattgaatgcgaaaccggtccaaacccccaatgggccgtgatttggctgcatggcttgggtgctgatggttctgactttgcaccgatggttccggaactggtcagtccacaatggccagcgttacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcacgcttgaatggcatagctacccgatgggccatcaagtgtgcgtagaggaaatcgatcatcttcgtgattggatgcaggctcgcttcaccgcggtt

SEQ ID NO: 170 - protein, 231 aa, Artificial Sequence
  Engineered Variants of Esterase  from  Xanthomonas campestris
MPSPVTGRCIGLDVIECETGPNPQWAVIWLHGLGADGSDFAPMVPELVSPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFTLEWHSYPMGHQVCVEEIDHLRDWMQARFTAV

SEQ ID NO: 171 - DNA, 693 bp, Artificial Sequence
  Engineered Variants of Esterase  from  Xanthomonas campestris
atgccgagccccgtgactggtcgatgcattatcttagacgtgattgaacgtgaaaccggtccaaacccccaatgggccgtgatttggctgcatggcttgggtcaggatggttctgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcgcgcttgaatggcatagctacccgatgggccatcaagtgtgctgggaggaaatcgatgcccttcgtgattggatgcaggcccgcttcaccgcggtt

SEQ ID NO: 172 - protein, 231 aa, Artificial Sequence
  Engineered Variants of Esterase  from  Xanthomonas campestris
MPSPVTGRCIILDVIERETGPNPQWAVIWLHGLGQDGSDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFALEWHSYPMGHQVCWEEIDALRDWMQARFTAV

SEQ ID NO: 173 - DNA, 693 bp, Artificial Sequence
  Engineered Variants of Esterase  from  Xanthomonas campestris
atgccgagccccgtgactggtcgatgtattatgttagatgtgattgaagtggaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcgcgcttgaatggcatagctacccgatgggccatcaagtgtgctgggaggaaatcgatgcccttcgtgattggatgcaggcccgcttcaccgcggtt

SEQ ID NO: 174 - protein, 231 aa, Artificial Sequence
  Engineered Variants of Esterase  from  Xanthomonas campestris
MPSPVTGRCIMLDVIEVETGPNPQWAVIWLHGLGADGSDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFALEWHSYPMGHQVCWEEIDALRDWMQARFTAV

SEQ ID NO: 175 - DNA, 693 bp, Artificial Sequence
  Engineered Variants of Esterase  from  Xanthomonas campestris
atgccgagccctgtgccgggtcgctgcattacgttagacgtgattgaacgtgaaaccggtccaaacccccaatgggccgtgatttggctgcatggcttgggtgctaacggtagtgactttgcaccgatggttccggaactggtccgtccacaatggccagcattacgcttcgtgtttcctcacgcgccgattcgcccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgcaggagaacaaagtgcacaggcattgcaagcattaggtttcgcgcttgaatggcatagctacccgatgggccatcaagtgtgctgggaggaaatcgatgcccttcgtgattggatgcaggcccgcttcatggcggtt

SEQ ID NO: 176 - protein, 231 aa, Artificial Sequence
  Engineered Variants of Esterase  from  Xanthomonas campestris
MPSPVPGRCITLDVIERETGPNPQWAVIWLHGLGANGSDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFALEWHSYPMGHQVCWEEIDALRDWMQARFMAV

SEQ ID NO: 177 - DNA, 693 bp, Artificial Sequence
  Engineered Variants of Esterase  from  Xanthomonas campestris
atgccgagccccgtgactggtcgatgcattatgctggacgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcctgcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcaatggcattgcaagcattaggtttcacgcttgaatggcatagctacccgatgggccatcaagtgtgcgtagaggaaatcgatgcccttcgtgattggatgcaagctcgcttcaccgcggtt

SEQ ID NO: 178 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITIWNGLRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAMALQALGFTLEWHSYPMGHQVCVEEIDALRDWMQARFTAV

SEQ ID NO: 179 - DNA, 693 bp, Artificial Sequence
  Engineered Variants of Esterase  from  Xanthomonas campestris
atgccgagccccgtgactggtcgatgtattattttagatgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatcgtggggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcaccgcggtt

SEQ ID NO: 180 - protein, 231 aa, Artificial Sequence
  Engineered Variants of Esterase  from  Xanthomonas campestris
MPSPVTGRCIILDVIERETGPNPQWAVIWLHGLGADGSDFAPMVPELVRPQWPALRFVFPHAPIRPITIWNGVRMRGWYDIVGMDFAQRADKVGIAESVAQVEALIANEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFTAV

SEQ ID NO: 181 - DNA, 693 bp, Artificial Sequence
  Engineered Variants of Esterase  from  Xanthomonas campestris
atgccgagccccgtgactggtcgctgtattatgttagaagtgattgaacgtgaaaccgggccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcacggcggtt

SEQ ID NO: 182 - protein, 231 aa, Artificial Sequence
  Engineered Variants of Esterase  from  Xanthomonas campestris
MPSPVTGRCIMLEVIERETGPNPQWAVIWLHGLGADGSDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFTAV

SEQ ID NO: 183 - DNA, 693 bp, Artificial Sequence
  Engineered Variants of Esterase  from  Xanthomonas campestris
atgccgagccccgtgactggtcgatgcattatgttagacgtgattgaacgtgaaaccggtccaaacccccaatgggccgtgatttggctgcatggcttgggtgctgatggttctgactttgcaccgatggttccggaactggtcagtccagactggccagcgttacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctcatgaacaggcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcacccttgaatggcatagctacccgatgggccatcaagtgtgcgtagaggaaatcgatcatcttcgtgattggatgcaggctcgcttcaccgcggtt

SEQ ID NO: 184 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVSPDWPALRFVFPHAPIRPITIWNGVRMRGWYDIQGMDFAQRADKVGIAESVAQVEALIAHEQARGIAPDRILLAGFSQGGAVTLAVGLQRRVPLAGLIALSTYLPDPAAAASQLQPGALAQPLFMAHGSADLVVPYRAGEQSAQALQALGFTLEWHSYPMGHQVCVEEIDHLRDWMQARFTAV

SEQ ID NO: 185 - DNA, 693 bp, Artificial Sequence
  Engineered Variants of Esterase  from  Xanthomonas campestris
atgccgagccccgtgactggtcgatgcattgagttagacgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcccgcaacgtgcggataaggtgggtattgcggagagtgttgcacaagttgaagccctgattgctaatgaaatggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcacccttgaatggcatagctacccgatgggccatcaagtgtgcgtagaggaaatcgatcatcttcgtgattggatgcaggctcgcttcaccgcggtt

SEQ ID NO: 186 - protein, 231 aa, Artificial Sequence
  Engineered Variants of Esterase  from  Xanthomonas campestris
MPSPVTGRCIELDVIERETGPNPQWAVIWLHGLGADGSDFAPMVPELVRPQWPALRFVFPHAPIRPITIWNGVRMRGWYDIQGMDFPQRADKVGIAESVAQVEALIANEMARGIAPDRILLAGFSQGGAVTLAVGLQRRVPLAGLIAMSTYLPDPAAAASQLQPGALAQPLFMAHGSADLVVPYRAGEQSAQALQALGFTLEWHSYPMGHQVCVEEIDHLRDWMQARFTAV

SEQ ID NO: 187 - DNA, 693 bp, Artificial Sequence
  Engineered Variants of Esterase  from  Xanthomonas campestris
atgccgagccccgtgactggtcgatgcattgagttagacgtgattgaacgtgaaaccggtccaaacccccaatgggccgtgatttggctgcatggcttgggtgctgatggttctgactttgcaccgatggttccggaactggtccgtccacaatggccatcgttacgcttcgtgtttcctcacgcgccgattcgtccgatcacgatctggaatggcgtgcgcatgcgtggttggtacgacatccaagggatggacttcccgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcaatggcattgcaagcattaggtttcacccttgaatggcatagctacccgatgggccatcaagtgtgcgtagaggaaatcgatgcccttcgtgattggatgcaggctcgcttcaccgcggtt

SEQ ID NO: 188 - protein, 231 aa, Artificial Sequence
  Engineered Variants of Esterase  from  Xanthomonas campestris
MPSPVTGRCIELDVIERETGPNPQWAVIWLHGLGADGSDFAPMVPELVRPQWPSLRFVFPHAPIRPITIWNGVRMRGWYDIQGMDFPQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAMALQALGFTLEWHSYPMGHQVCVEEIDALRDWMQARFTAV

SEQ ID NO: 189 - DNA, 693 bp, Artificial Sequence
  Engineered Variants of Esterase  from  Xanthomonas campestris
atgccgagccccgtgactggtcgatgcattatgttagacgtgattgaagtggaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctcatgaacaggcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggctcgcttcaccgcggtt

SEQ ID NO: 190 - protein, 231 aa, Artificial Sequence
  Engineered Variants of Esterase  from  Xanthomonas campestris
MPSPVTGRCIMLDVIEVETGPNPQWAVIWLHGLGADGSDFAPMVPELVRPQWPALRFVFPHAPIRPITIWNGVRMRGWYDIQGMDFAQRADKVGIAESVAQVEALIAHEQARGIAPDRILLAGFSQGGAVTLAVGLQRRVPLAGLIALSTYLPDPAAAASQLQPGALAQPLFMAHGSADLVVPYRAGEQSAQALQALGFTLEWHSYPMGHQVCVEEIDALRDWMQARFTAV

SEQ ID NO: 191 - DNA, 693 bp, Artificial Sequence
  Engineered Variants of Esterase  from  Xanthomonas campestris
atgccgagccccgtgactggtcgatgcattgagttagacgtgattgaacgtgaaaccggtccaaacccccaatgggccgtgatttggctgcatggcttgggtgctgatggttctgactttgcaccgatggttccggaactggtcagtccagactggccagcgttacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctcatgaaatggcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggctcgcttcaccgcggtt

SEQ ID NO: 192 - protein, 231 aa, Artificial Sequence
  Engineered Variants of Esterase  from  Xanthomonas campestris
MPSPVTGRCIELDVIERETGPNPQWAVIWLHGLGADGSDFAPMVPELVSPDWPALRFVFPHAPIRPITIWNGVRMRGWYDIQGMDFAQRADKVGIAESVAQVEALIAHEMARGIAPDRILLAGFSQGGAVTLAVGLQRRVPLAGLIALSTYLPDPAAAASQLQPGALAQPLFMAHGSADLVVPYRAGEQSAQALQALGFTLEWHSYPMGHQVCVEEIDALRDWMQARFTAV

SEQ ID NO: 193 - DNA, 693 bp, Artificial Sequence
  Engineered Variants of Esterase  from  Xanthomonas campestris
atgccgagccccgtgactggtcgatgcattgggttagacgtgattgaacgtgaaaccggtccaaacccccaatgggccgtgatttggctgcatggcttgggtgctgatggttctgactttgcaccgatggttccggaactggtccgtccagactggccagcgttacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaaatggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcaatggcattgcaagcattaggtttcacccttgaatggcatagctacccgatgggccatcaagtgtgcgtagaggaaatcgatcatcttcgtgattggatgcaggctcgcttcaccgcggtt

SEQ ID NO: 194 - protein, 231 aa, Artificial Sequence
  Engineered Variants of Esterase  from  Xanthomonas campestris
MPSPVTGRCIGLDVIERETGPNPQWAVIWLHGLGADGSDFAPMVPELVRPDWPALRFVFPHAPIRPITIWNGVRMRGWYDIQGMDFAQRADKVGIAESVAQVEALIANEMARGIAPDRILLAGFSQGGAVTLAVGLQRRVPLAGLIAMSTYLPDPAAAASQLQPGALAQPLFMAHGSADLVVPYRAGEQSAMALQALGFTLEWHSYPMGHQVCVEEIDHLRDWMQARFTAV

SEQ ID NO: 195 - DNA, 693 bp, Artificial Sequence
  Engineered Variants of Esterase  from  Xanthomonas campestris
atgccgagccccgtgactggtcgatgtattatgttagatgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatcaacaatggcgttcgcatgcgtggttggtacgacatcgtggggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgccagggagaacaatcagcacaggcattgcaagcattaggtttcacccttgaatggcatagctacccgatgggccatcaagtgtgcgtagaggaaatcgatgcccttcgtgattggatgcaggcccgcttcaccgcggtt

SEQ ID NO: 196 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITINNGVRMRGWYDIVGMDFAQRADKVGIAESVAQVEALIANEQARGIAPDRILLAGFSQGGAVTLAVGLQRRVPLAGLIAMSTYLPDPAAAASQLQPGALAQPLFMAHGSADPVVPYRQGEQSAQALQALGFTLEWHSYPMGHQVCVEEIDALRDWMQARFTAV

SEQ ID NO: 197 - DNA, 693 bp, Artificial Sequence
  Engineered Variants of Esterase  from  Xanthomonas campestris
atgccgagccccgtgactggtcgatgcattatgttagacgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaaatggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcacccttgaatggcatagctacccgatgggccatcaagtgtgcgtagaggaaatcgatcatcttcgtgattggatgcaggctcgcttcaccgcggtt

SEQ ID NO: 198 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITIWNGVRMRGWYDIQGMDFAQRADKVGIAESVAQVEALIANEMARGIAPDRILLAGFSQGGAVTLAVGLQRRVPLAGLIAMSTYLPDPAAAASQLQPGALAQPLFMAHGSADLVVPYRAGEQSAQALQALGFTLEWHSYPMGHQVCVEEIDHLRDWMQARFTAV

SEQ ID NO: 199 - DNA, 693 bp, Artificial Sequence
  Engineered Variants of Esterase  from  Xanthomonas campestris
atgccgagccgtgtgacgggtggctgcattacgttagacgtgattgaacgtgaaaccggtccaaacccccaatgggccgtgatttggctgcatggcttgggtgctgacggtagtgactttgcaccgatggttccggaactggtccgtccacaatggccagcattacgcttcgtgtttcctcacgcgccgattcgcccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgcaggagaacaaagtgcacaggcattgcaagcattaggtttcgcgcttgaatggcatagctacccgatgggccatcaagtgtgctgggaggaaatcgatgcccttcgtgattggatgcaggcccgcttcatggcggtt

SEQ ID NO: 200 - protein, 231 aa, Artificial Sequence
  Engineered Variants of Esterase  from  Xanthomonas campestris
MPSRVTGGCITLDVIERETGPNPQWAVIWLHGLGADGSDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFALEWHSYPMGHQVCWEEIDALRDWMQARFMAV

SEQ ID NO: 201 - DNA, 693 bp, Artificial Sequence
  Engineered Variants of Esterase  from  Xanthomonas campestris
atgccgagccgtgtgacgggtggctgcattatgttagacgtgattgaacgtgaaaccggtccaaacccccaatgggccgtgatttggctgcatggcttgggtgctaacggttatgactttgcaccgatggttccggaactggtccgtccacaatggccagcattacgcttcgtgtttcctcacgcgccgattcgcccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgcaggagaacaaagtgcacaggcattgcaagcattaggtttcgcgcttgaatggcatagctacccgatgggccatcaagtgtgctgggaggaaatcgatgcccttcgtgattggatgcaggcccgcttcatggcggtt

SEQ ID NO: 202 - protein, 231 aa, Artificial Sequence
  Engineered Variants of Esterase  from  Xanthomonas campestris
MPSRVTGGCIMLDVIERETGPNPQWAVIWLHGLGANGYDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFALEWHSYPMGHQVCWEEIDALRDWMQARFMAV

SEQ ID NO: 203 - DNA, 693 bp, Artificial Sequence
  Engineered Variants of Esterase  from  Xanthomonas campestris
atgccgagccccgtgactggtcgatgcattatgttagacgtgattgaacgtgaaaccggtccaaacccccaatgggccgtgatttggctgcatggcttgggtgctgatggttctgactttgcaccgatggttccggaactggtccgtccacaatggccagcgttacgcttcgtgtttcctcacgcgccgattcgtccgatcacgatctggaatggcgtgcgcatgcgtggttggtacgacatccaagggatggacttcccgcaacgtgcggataaggtgggtattgcggagagtgttgcacaagttgaagccctgattgctcatgaaatggcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcaatggcattgcaagcattaggtttcacccttgaatggcatagctacccgatgggccatcaagtgtgcgtagaggaaatcgatcatcttcgtgattggatgcaggctcgcttcaccgcggtt

SEQ ID NO: 204 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITIWNGVRMRGWYDIQGMDFPQRADKVGIAESVAQVEALIAHEMARGIAPDRILLAGFSQGGAVTLAVGLQRRVPLAGLIALSTYLPDPAAAASQLQPGALAQPLFMAHGSADLVVPYRAGEQSAMALQALGFTLEWHSYPMGHQVCVEEIDHLRDWMQARFTAV

SEQ ID NO: 205 - DNA, 693 bp, Artificial Sequence
  Engineered Variants of Esterase  from  Xanthomonas campestris
atgccgagccccgtgactggtcgatgtattatgttagatgtgattgaagctgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcgcgcttgaatggcatagctacccgatgggccatcaagtgtgctgggaggaaatcgatgcccttcgtgattggatgcaggcccgcttcaccgcggtt

SEQ ID NO: 206 - protein, 231 aa, Artificial Sequence
  Engineered Variants of Esterase  from  Xanthomonas campestris
MPSPVTGRCIMLDVIEAETGPNPQWAVIWLHGLGADGSDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFALEWHSYPMGHQVCWEEIDALRDWMQARFTAV

SEQ ID NO: 207 - DNA, 693 bp, Artificial Sequence
  Engineered Variants of Esterase  from  Xanthomonas campestris
atgccgagccccgtgactggtcgatgcattgagttagacgtgattgaacgtgaaaccggtccaaacccccaatgggccgtgatttggctgcatggcttgggtgctgatggttctgactttgcaccgatggttccggaactggtcagtccagactggccatcgttacgcttcgtgtttcctcacgcgccgattcgtccgatcacgatctggaatggcgttcgcatgcgtggttggtacgacatccaagggatggacttcccgcaacgtgcggataaggtgggtattgcggagagtgttgcacaagttgaagccctgattgctcatgaaatggcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcacaagcattgcaagcattaggtttcacccttgaatggcatagctacccgatgggccatcaagtgtgcgtagaggaaatcgatcatcttcgtgattggatgcaggctcgcttcaccgcggtt

SEQ ID NO: 208 - protein, 231 aa, Artificial Sequence
  Engineered Variants of Esterase  from  Xanthomonas campestris
MPSPVTGRCIELDVIERETGPNPQWAVIWLHGLGADGSDFAPMVPELVSPDWPSLRFVFPHAPIRPITIWNGVRMRGWYDIQGMDFPQRADKVGIAESVAQVEALIAHEMARGIAPDRILLAGFSQGGAVTLAVGLQRRVPLAGLIALSTYLPDPAAAASQLQPGALAQPLFMAHGSADLVVPYRAGEQSAQALQALGFTLEWHSYPMGHQVCVEEIDHLRDWMQARFTAV

SEQ ID NO: 209 - DNA, 693 bp, Artificial Sequence
  Engineered Variants of Esterase  from  Xanthomonas campestris
atgccgagccccgtgactggtcgatgcattatcttagacgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggccggcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcgcgcttgaatggcatagctacccgatgggccatcaagtgtgctgggaggaaatcgatgcccttcgtgattggatgcaggcccgcttcaccgcggtt

SEQ ID NO: 210 - protein, 231 aa, Artificial Sequence
  Engineered Variants of Esterase  from  Xanthomonas campestris
MPSPVTGRCIILDVIERETGPNPQWAVIWLHGLGADGSDFAPMVPELVRPQWPALRFVFPHAPIRPITIWNGRRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFALEWHSYPMGHQVCWEEIDALRDWMQARFTAV

SEQ ID NO: 211 - DNA, 693 bp, Artificial Sequence
  Engineered Variants of Esterase  from  Xanthomonas campestris
atgccgagccgtgtgccgggtcgctgcattatcttagacgtgattgaacgtgaaaccggtccaaacccccaatgggccgtgatttggctgcatggcttgggtgctgacggttatgactttgcaccgatggttccggaactggtccgtccacaatggccagcattacgcttcgtgtttcctcacgcgccgattcgcccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgctttggagaacaaagtgcacaggcattgcaagcattaggtttcgcgcttgaatggcatagctacccgatgggccatcaagtgtgctgggaggaaatcgatgcccttcgtgattggatgcaggcccgcttcacggcggtt

SEQ ID NO: 212 - protein, 231 aa, Artificial Sequence
  Engineered Variants of Esterase  from  Xanthomonas campestris
MPSRVPGRCIILDVIERETGPNPQWAVIWLHGLGADGYDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRFGEQSAQALQALGFALEWHSYPMGHQVCWEEIDALRDWMQARFTAV

SEQ ID NO: 213 - DNA, 693 bp, Artificial Sequence
  Engineered Variants of Esterase  from  Xanthomonas campestris
atgccgagccccgtgactggtcgatgcattatgttagacgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgtgcgcatgcgtggttggtacgacatccaagggatggacttcgcgcaacgtgcggataaggtgggtattgcggagagtgttgcacaagttgaagccctgattgctaatgaaatggcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcacgcttgaatggcatagctacccgatgggccatcaagtgtgcgtagaggaaatcgatgcacttcgtgattggatgcaggctcgcttcaccgcggtt

SEQ ID NO: 214 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITIWNGVRMRGWYDIQGMDFAQRADKVGIAESVAQVEALIANEMARGIAPDRILLAGFSQGGAVTLAVGLQRRVPLAGLIALSTYLPDPAAAASQLQPGALAQPLFMAHGSADLVVPYRAGEQSAQALQALGFTLEWHSYPMGHQVCVEEIDALRDWMQARFTAV

SEQ ID NO: 215 - DNA, 693 bp, Artificial Sequence
  Engineered Variants of Esterase  from  Xanthomonas campestris
atgccgagccccgtgactggtcgatgcattgagccggacgtgattgaacgtgaaaccggtccaaacccccaatgggccgtgatttggctgcatggcttgggtgctgatggttctgactttgcaccgatggttccggaactggtccgtccagactggccagcgttacgcttcgtgtttcctcacgcgccgattcgtccgatcacgatctggaatggcatgcgcatgcgtggttggtacgacatcgtggggatggacttcgcgcaacgtgcggataaggtgggtattgcggagagtgttgcacaagttgaagccctgattgctaacgaaatggcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcacaagcattgcaagcattaggtttcacgcttgaatggcatagctacccgatgggccatcaagtgtgcgtagaggaaatcgatgcccttcgtgattggatgcaggctcgcttcaccgcggtt

SEQ ID NO: 216 - protein, 231 aa, Artificial Sequence
  Engineered Variants of Esterase  from  Xanthomonas campestris
MPSPVTGRCIEPDVIERETGPNPQWAVIWLHGLGADGSDFAPMVPELVRPDWPALRFVFPHAPIRPITIWNGMRMRGWYDIVGMDFAQRADKVGIAESVAQVEALIANEMARGIAPDRILLAGFSQGGAVTLAVGLQRRVPLAGLIALSTYLPDPAAAASQLQPGALAQPLFMAHGSADLVVPYRAGEQSAQALQALGFTLEWHSYPMGHQVCVEEIDALRDWMQARFTAV

SEQ ID NO: 217 - DNA, 693 bp, Artificial Sequence
  Engineered Variants of Esterase  from  Xanthomonas campestris
atgccgagccccgtgactggtcgatgtattatgttagatgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatcaggaatggcgttcgcatgcgtggttggtacgacatcgtggggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcaccgcggtt

SEQ ID NO: 218 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITIRNGVRMRGWYDIVGMDFAQRADKVGIAESVAQVEALIANEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFTAV

SEQ ID NO: 219 - DNA, 693 bp, Artificial Sequence
  Engineered Variants of Esterase  from  Xanthomonas campestris
atgccgagccccgtgactggtcgacgcattgagagcgacgtgattgaacgtgaaaccggtccaaacccccaatgggccgtgatttggctgcatggcttgggtgctgatggttctgactttgcaccgatggttccggaactggtccgtccagactggccatcgttacgcttcgtgtttcctcacgcgccgattcgtccgatcacgatctggaatggcatgcgcatgcgtggttggtacgacatccaggggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcacgcttgaatggcatagctacccgatgggccatcaagtgtgcgtagaggaaatcgatgcccttcgtgattggatgtcggctcgcttcaccgcggtt

SEQ ID NO: 220 - protein, 231 aa, Artificial Sequence
  Engineered Variants of Esterase  from  Xanthomonas campestris
MPSPVTGRRIESDVIERETGPNPQWAVIWLHGLGADGSDFAPMVPELVRPDWPSLRFVFPHAPIRPITIWNGMRMRGWYDIQGMDFAQRADKVGIAESVAQVEALIANEQARGIAPDRILLAGFSQGGAVTLAVGLQRRVPLAGLIALSTYLPDPAAAASQLQPGALAQPLFMAHGSADLVVPYRAGEQSAQALQALGFTLEWHSYPMGHQVCVEEIDALRDWMSARFTAV

SEQ ID NO: 221 - DNA, 693 bp, Artificial Sequence
  Engineered Variants of Esterase  from  Xanthomonas campestris
atgccgagccccgtgactggtcgacgcattgagccggacgtgattgaacgtgaaaccggtccaaacccccaatgggccgtgatttggctgcatggcttgggtgctgatggttctgactttgcaccgatggttccggaactggtccgtccagactggccagcgttacgcttcgtgtttcctcacgcgccgattcgtccgatcacgatctggaatggcatgcgcatgcgtggttggtacgacatccaagggatggacttcgcgcaacgtgcggataaggtgggtattgcggagagtgttgcacaagttgaagccctgattgctaacgaacaagcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttccatcttgaatggcatagctacccgatgggccatcaagtgtgcgtagaggaaatcgatgcccttcgtgattggatgtcggctcgcttcaccgcggtt

SEQ ID NO: 222 - protein, 231 aa, Artificial Sequence
  Engineered Variants of Esterase  from  Xanthomonas campestris
MPSPVTGRRIEPDVIERETGPNPQWAVIWLHGLGADGSDFAPMVPELVRPDWPALRFVFPHAPIRPITIWNGMRMRGWYDIQGMDFAQRADKVGIAESVAQVEALIANEQARGIAPDRILLAGFSQGGAVTLAVGLQRRVPLAGLIALSTYLPDPAAAASQLQPGALAQPLFMAHGSADLVVPYRAGEQSAQALQALGFHLEWHSYPMGHQVCVEEIDALRDWMSARFTAV

SEQ ID NO: 223 - DNA, 693 bp, Artificial Sequence
  Engineered Variants of Esterase  from  Xanthomonas campestris
atgccgagccccgtgactggtcgatgtattatgttagatgtgattgaacgtgaaaccggtccaaacccccaatgggccgtgatttggctgcatggcttgggtgctgatggttctgactttgcaccgatggttaccgaactggtccgtccacaatggccagccttacgcttcgtgtttcctcacgcgccgattcgtccgatcacgatctggaatggcgttcgcatgcgtggttggtacgacatcgtggggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcaccgcggtt

SEQ ID NO: 224 - protein, 231 aa, Artificial Sequence
  Engineered Variants of Esterase  from  Xanthomonas campestris
MPSPVTGRCIMLDVIERETGPNPQWAVIWLHGLGADGSDFAPMVTELVRPQWPALRFVFPHAPIRPITIWNGVRMRGWYDIVGMDFAQRADKVGIAESVAQVEALIANEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFTAV

SEQ ID NO: 225 - DNA, 693 bp, Artificial Sequence
  Engineered Variants of Esterase  from  Xanthomonas campestris
atgccgagccccgtgactggtcgatgcattatcttagacgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggcatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcgcgcttgaatggcatagctacccgatgggccatcaagtgtgctgggaggaaatcgatgcccttcgtgattggatgcaggcccgcttcaccgcggtt

SEQ ID NO: 226 - protein, 231 aa, Artificial Sequence
  Engineered Variants of Esterase  from  Xanthomonas campestris
MPSPVTGRCIILDVIERETGPNPQWAVIWLHGLGADGSDFAPMVPELVRPQWPALRFVFPHAPIRPITIWHGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFALEWHSYPMGHQVCWEEIDALRDWMQARFTAV

SEQ ID NO: 227 - DNA, 693 bp, Artificial Sequence
  Engineered Variants of Esterase  from  Xanthomonas campestris
atgccgagccccgtgactggtcgatgcattatgttagacgtgattgaacgcgaaaccggtccaaacccccaatgggccgtgatttggctgcatggcttgggtgctgatggttctgactttgcaccgatggttccggaactggtccgtccacaatggccagcgttacgcttcgtgtttcctcacgcgccgattcgtccgatcacgatctggaatggcctgcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcaatggcattgcaagcattaggtttcacccttgaatggcatagctacccgatgggccatcaagtgtgcgtagaggaaatcgatcatcttcgtgattggatgcaggctcgcttcaccgcggtt

SEQ ID NO: 228 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITIWNGLRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAMALQALGFTLEWHSYPMGHQVCVEEIDHLRDWMQARFTAV

SEQ ID NO: 229 - DNA, 693 bp, Artificial Sequence
  Engineered Variants of Esterase  from  Xanthomonas campestris
atgccgagccccgtgactggtcgatgtattatgttagatgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatcaacaatggcgttcgcatgcgtggttggtacgacatcgtggggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaacagttaggtttcacccttgaatggcatagctacccgatgggccatcaagtgtgcgtagaggaaatcgatgcccttcgtgattggatgcaggcccgcttcaccgcggtt

SEQ ID NO: 230 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITINNGVRMRGWYDIVGMDFAQRADKVGIAESVAQVEALIANEQARGIAPDRILLAGFSQGGAVTLAVGLQRRVPLAGLIAMSTYLPDPAAAASQLQPGALAQPLFMAHGSADPVVPYRAGEQSAQALQQLGFTLEWHSYPMGHQVCVEEIDALRDWMQARFTAV

SEQ ID NO: 231 - DNA, 693 bp, Artificial Sequence
  Engineered Variants of Esterase  from  Xanthomonas campestris
atgccgagccctgtgccgggtcgctgcattatgttagacgtgattgaacgtgaaaccggtccaaacccccaatgggccgtgatttggctgcatggcttgggtgctgacggtagtgactttgcaccgatggttccggaactggtccgtccacaatggccagcattacgcttcgtgtttcctcacgcgccgattcgcccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgctttggagaacaaagtgcacaggcattgcaagcattaggtttcgcgcttgaatggcatagctacccgatgggccatcaagtgtgctgggaggaaatcgatgcccttcgtgattggatgcaggcccgcttcatggcggtt

SEQ ID NO: 232 - protein, 231 aa, Artificial Sequence
  Engineered Variants of Esterase  from  Xanthomonas campestris
MPSPVPGRCIMLDVIERETGPNPQWAVIWLHGLGADGSDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRFGEQSAQALQALGFALEWHSYPMGHQVCWEEIDALRDWMQARFMAV

SEQ ID NO: 233 - DNA, 693 bp, Artificial Sequence
  Engineered Variants of Esterase  from  Xanthomonas campestris
atgccgagccccgtgactggtcgatgtattgggttagatgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcgcgcttgaatggcatagctacccgatgggccatcaagtgtgctgggaggaaatcgatgcccttcgtgattggatgcaggcccgcttcaccgcggtt

SEQ ID NO: 234 - protein, 231 aa, Artificial Sequence
  Engineered Variants of Esterase  from  Xanthomonas campestris
MPSPVTGRCIGLDVIERETGPNPQWAVIWLHGLGADGSDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFALEWHSYPMGHQVCWEEIDALRDWMQARFTAV

SEQ ID NO: 235 - DNA, 693 bp, Artificial Sequence
  Engineered Variants of Esterase  from  Xanthomonas campestris
atgccgagccccgtgactggtcgatgcattatcttagacgtgattgaacgtgaaaccggtccaaacccccaatgggccgtgatttggctgcatggcttgggtgctaacggttatgactttgcaccgatggttccggaactggtccgtccacaatggccagcattacgcttcgtgtttcctcacgcgccgattcgcccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgcaggagaacaaagtgcacaggcattgcaagcattaggtttcgcgcttgaatggcatagctacccgatgggccatcaagtgtgctgggaggaaatcgatgcccttcgtgattggatgcaggcccgcttcatggcggtt

SEQ ID NO: 236 - protein, 231 aa, Artificial Sequence
  Engineered Variants of Esterase  from  Xanthomonas campestris
MPSPVTGRCIILDVIERETGPNPQWAVIWLHGLGANGYDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFALEWHSYPMGHQVCWEEIDALRDWMQARFMAV

SEQ ID NO: 237 - DNA, 693 bp, Artificial Sequence
  Engineered Variants of Esterase  from  Xanthomonas campestris
atgccgagccgtgtgacgggtggctgcattacgttagacgtgattgaacgtgaaaccggtccaaacccccaatgggccgtgatttggctgcatggcttgggtgctaacggtagtgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgctttggagaacaaagtgcacaggcattgcaagcattaggtttcgcgcttgaatggcatagctacccgatgggccatcaagtgtgctgggaggaaatcgatgcccttcgtgattggatgcaggcccgcttcatggcggtt

SEQ ID NO: 238 - protein, 231 aa, Artificial Sequence
  Engineered Variants of Esterase  from  Xanthomonas campestris
MPSRVTGGCITLDVIERETGPNPQWAVIWLHGLGANGSDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRFGEQSAQALQALGFALEWHSYPMGHQVCWEEIDALRDWMQARFMAV

SEQ ID NO: 239 - DNA, 693 bp, Artificial Sequence
  Engineered Variants of Esterase  from  Xanthomonas campestris
atgccgagccccgtgactggtcgctgtattatgttagaagtgattgaacgtgaaaccgggccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatcgtagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcatggcggtt

SEQ ID NO: 240 - protein, 231 aa, Artificial Sequence
  Engineered Variants of Esterase  from  Xanthomonas campestris
MPSPVTGRCIMLEVIERETGPNPQWAVIWLHGLGADGSDFAPMVPELVRPQWPALRFVFPHAPIRPITIWNGVRMRGWYDIVGMDFAQRADKVGIAESVAQVEALIANEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFMAV

SEQ ID NO: 241 - DNA, 693 bp, Artificial Sequence
  Engineered Variants of Esterase  from  Xanthomonas campestris
atgccgagccccgtgactggtcgatgtattatgttagatgtgattgaacgtgaaaccggtccaaacccccaatgggccgtgatttggctgcatggcttgggtgctgatggttctgcgtttgcaccgatggttccggaactggtccgtccacaatggccagcattacgcttcgtgtttcctcacgcgccgattcgtccgatcacgatcaacaatggcgttcgcatgcgtggttggtacgacatcgtggggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcaccggagaacaatcagcacaggcattgcaagcattaggtttcacccttgaatggcatagctacccgatgggccatcaagtgtgcgtagaggaaatcgatgcccttcgtgattggatgcaggcccgcttcaccgcggtt

SEQ ID NO: 242 - protein, 231 aa, Artificial Sequence
  Engineered Variants of Esterase  from  Xanthomonas campestris
MPSPVTGRCIMLDVIERETGPNPQWAVIWLHGLGADGSAFAPMVPELVRPQWPALRFVFPHAPIRPITINNGVRMRGWYDIVGMDFAQRADKVGIAESVAQVEALIANEQARGIAPDRILLAGFSQGGAVTLAVGLQRRVPLAGLIAMSTYLPDPAAAASQLQPGALAQPLFMAHGSADPVVPYRTGEQSAQALQALGFTLEWHSYPMGHQVCVEEIDALRDWMQARFTAV

SEQ ID NO: 243 - DNA, 693 bp, Artificial Sequence
  Engineered Variants of Esterase  from  Xanthomonas campestris
atgccgagccccgtgactggtcgatgtattatgttagatgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatcaacaatggcgttcgcatgcgtggttggtacgacatcgtggggatggacttcgcggggcgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcaccgcggtt

SEQ ID NO: 244 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITINNGVRMRGWYDIVGMDFAGRADKVGIAESVAQVEALIANEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFTAV

SEQ ID NO: 245 - DNA, 693 bp, Artificial Sequence
  Engineered Variants of Esterase  from  Xanthomonas campestris
atgccgagccccgtgactggtcgatgcattatgttagacgtgattgaacgtgaaaccggtccaaacccccaatgggccgtgatttggctgcatggcttgggtgctgatggttctgactttgcaccgatggttccggaactggtcagtccacaatggccagcgttacgcttcgtgtttcctcacgcgccgattcgtccgatcacgatctggaatggcgtgcgcatgcgtggttggtacgacatccaagggatggacttcgcgcaacgtgcggataaggtgggtattgcggagagtgttgcacaagttgaagccctgattgctaatgaaatggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcacgcttgaatggcatagctacccgatgggccatcaagtgtgcgtagaggaaatcgatcatcttcgtgattggatgcaggctcgcttcaccgcggtt

SEQ ID NO: 246 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVSPQWPALRFVFPHAPIRPITIWNGVRMRGWYDIQGMDFAQRADKVGIAESVAQVEALIANEMARGIAPDRILLAGFSQGGAVTLAVGLQRRVPLAGLIAMSTYLPDPAAAASQLQPGALAQPLFMAHGSADLVVPYRAGEQSAQALQALGFTLEWHSYPMGHQVCVEEIDHLRDWMQARFTAV

SEQ ID NO: 247 - DNA, 693 bp, Artificial Sequence
  Engineered Variants of Esterase  from  Xanthomonas campestris
atgccgagccccgtgactggtcgatgcattgagttagacgtgattgaacacgaaaccggtccaaacccccaatgggccgtgatttggctgcatggcttgggtgctgatggttctgactttgcaccgatggttccggaactggtccgtccagactggccatcgttacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcacccttgaatggcatagctacccgatgggccatcaagtgtgcgtagaggaaatcgatgcacttcgtgattggatgcaggctcgcttcaccgcggtt

SEQ ID NO: 248 - protein, 231 aa, Artificial Sequence
  Engineered Variants of Esterase  from  Xanthomonas campestris
MPSPVTGRCIELDVIEHETGPNPQWAVIWLHGLGADGSDFAPMVPELVRPDWPSLRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFTLEWHSYPMGHQVCVEEIDALRDWMQARFTAV

SEQ ID NO: 249 - DNA, 693 bp, Artificial Sequence
  Engineered Variants of Esterase  from  Xanthomonas campestris
atgccgagccccgtgactggtcgatgcattatgttagacgtgattgaacgtgaaaccggtccaaacccccaatgggccgtgatttggctgcatggcttgggtgctgatggttctgactttgcaccgatggttccggaactggtccgtccagactggccatcgttacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggctcgcttcaccgcggtt

SEQ ID NO: 250 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPDWPSLRFVFPHAPIRPITIWNGVRMRGWYDIQGMDFAQRADKVGIAESVAQVEALIANEQARGIAPDRILLAGFSQGGAVTLAVGLQRRVPLAGLIALSTYLPDPAAAASQLQPGALAQPLFMAHGSADLVVPYRAGEQSAQALQALGFTLEWHSYPMGHQVCVEEIDALRDWMQARFTAV

SEQ ID NO: 251 - DNA, 693 bp, Artificial Sequence
  Engineered Variants of Esterase  from  Xanthomonas campestris
atgccgagccccgtgactggtcgatgcattatgctggacgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcctgcgcatgcgtggttggtacgacatccaggggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttccatcttgaatggcatagctacccgatgggccatcaagtgtgcgtagaggaaatcgatgcccttcgtgattggatgcaagctcgcttcaccgcggtt

SEQ ID NO: 252 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITIWNGLRMRGWYDIQGMDFAQRADKVGIAESVAQVEALIANEQARGIAPDRILLAGFSQGGAVTLAVGLQRRVPLAGLIALSTYLPDPAAAASQLQPGALAQPLFMAHGSADLVVPYRAGEQSAQALQALGFHLEWHSYPMGHQVCVEEIDALRDWMQARFTAV

SEQ ID NO: 253 - DNA, 693 bp, Artificial Sequence
  Engineered Variants of Esterase  from  Xanthomonas campestris
atgccgagccctgtgccgggtggctgcattatgttagacgtgattgaacgtgaaaccggtccaaacccccaatgggccgtgatttggctgcatggcttgggtgctgacggttatgactttgcaccgatggttccggaactggtccgtccacaatggccagcattacgcttcgtgtttcctcacgcgccgattcgcccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgcaggagaacaaagtgcacaggcattgcaagcattaggtttcgcgcttgaatggcatagctacccgatgggccatcaagtgtgctgggaggaaatcgatgcccttcgtgattggatgcaggcccgcttcacggcggtt

SEQ ID NO: 254 - protein, 231 aa, Artificial Sequence
  Engineered Variants of Esterase  from  Xanthomonas campestris
MPSPVPGGCIMLDVIERETGPNPQWAVIWLHGLGADGYDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFALEWHSYPMGHQVCWEEIDALRDWMQARFTAV

SEQ ID NO: 255 - DNA, 693 bp, Artificial Sequence
  Engineered Variants of Esterase  from  Xanthomonas campestris
atgccgagccctgtgccgggtcgctgcattatgttagacgtgattgaacgtgaaaccggtccaaacccccaatgggccgtgatttggctgcatggcttgggtgctgacggttatgactttgcaccgatggttccggaactggtccgtccacaatggccagcattacgcttcgtgtttcctcacgcgccgattcgcccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgctttggagaacaaagtgcacaggcattgcaagcattaggtttcgcgcttgaatggcatagctacccgatgggccatcaagtgtgctgggaggaaatcgatgcccttcgtgattggatgcaggcccgcttcatggcggtt

SEQ ID NO: 256 - protein, 231 aa, Artificial Sequence
  Engineered Variants of Esterase  from  Xanthomonas campestris
MPSPVPGRCIMLDVIERETGPNPQWAVIWLHGLGADGYDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRFGEQSAQALQALGFALEWHSYPMGHQVCWEEIDALRDWMQARFMAV

SEQ ID NO: 257 - DNA, 693 bp, Artificial Sequence
  Engineered Variants of Esterase  from  Xanthomonas campestris
atgccgagccccgtgactggtcgatgtattatgccggatgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcgcgcttgaatggcatagctacccgatgggccatcaagtgtgctgggaggaaatcgatgcccttcgtgattggatgcaggcccgcttcaccgcggtt

SEQ ID NO: 258 - protein, 231 aa, Artificial Sequence
  Engineered Variants of Esterase  from  Xanthomonas campestris
MPSPVTGRCIMPDVIERETGPNPQWAVIWLHGLGADGSDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFALEWHSYPMGHQVCWEEIDALRDWMQARFTAV

SEQ ID NO: 259 - DNA, 693 bp, Artificial Sequence
  Engineered Variants of Esterase  from  Xanthomonas campestris
atgccgagccccgtgactggtcgatgtattatgttagatgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatcgtggggatggacttcgcgcaacgtgcggataaggtgggtattgcggagagtgtagcacaagttgaagctctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagccaactgcaaccgcaagcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcaccgcggtt

SEQ ID NO: 260 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITIWNGVRMRGWYDIVGMDFAQRADKVGIAESVAQVEALIANEQARGIAPDRILLAGFSQGGAVTLAVGLQRRVPLAGLIAMSTYLPDPAAAASQLQPQALAQPLFMAHGSADPVVPYRAGEQSAQALQALGFTLEWHSYPMGHQVCVEEIDALRDWMQARFTAV

SEQ ID NO: 261 - DNA, 693 bp, Artificial Sequence
  Engineered Variants of Esterase  from  Xanthomonas campestris
atgccgagccccgtgactggtggctgtattacgttagatgtgattgaacgtgaaaccgggccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatcgtagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcacggcggtt

SEQ ID NO: 262 - protein, 231 aa, Artificial Sequence
  Engineered Variants of Esterase  from  Xanthomonas campestris
MPSPVTGGCITLDVIERETGPNPQWAVIWLHGLGADGSDFAPMVPELVRPQWPALRFVFPHAPIRPITIWNGVRMRGWYDIVGMDFAQRADKVGIAESVAQVEALIANEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFTAV

SEQ ID NO: 263 - DNA, 693 bp, Artificial Sequence
  Engineered Variants of Esterase  from  Xanthomonas campestris
atgccgagccccgtgactggtcgatgtattatgttagatgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatcaacaatggcgttcgcatgcgtggttggtacgacatcgtggggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaacgtttaggtttcacccttgaatggcatagctacccgatgggccatcaagtgtgcgtagaggaaatcgatgcccttcgtgattggatgcaggcccgcttcaccgcggtt

SEQ ID NO: 264 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITINNGVRMRGWYDIVGMDFAQRADKVGIAESVAQVEALIANEQARGIAPDRILLAGFSQGGAVTLAVGLQRRVPLAGLIAMSTYLPDPAAAASQLQPGALAQPLFMAHGSADPVVPYRAGEQSAQALQRLGFTLEWHSYPMGHQVCVEEIDALRDWMQARFTAV

SEQ ID NO: 265 - DNA, 693 bp, Artificial Sequence
  Engineered Variants of Esterase  from  Xanthomonas campestris
atgccgagccccgtgactggtcgatgcattatgttagacgtgattgaacgcgaaaccggtccaaacccccaatgggccgtgatttggctgcatggcttgggtgctgatggttctgactttgcaccgatggttccggaactggtccgtccacaatggccagcgttacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttccatcttgaatggcatagctacccgatgggccatcaagtgtgcgtagaggaaatcgatgcacttcgtgattggatgcaggctcgcttcaccgcggtt

SEQ ID NO: 266 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIALSTYLPDPAAAASQLQPGALAQPLFMAHGSADLVVPYRAGEQSAQALQALGFHLEWHSYPMGHQVCVEEIDALRDWMQARFTAV

SEQ ID NO: 267 - DNA, 693 bp, Artificial Sequence
  Engineered Variants of Esterase  from  Xanthomonas campestris
atgccgagccccgtgactggtcgatgcattatgttagacgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggctcgcttcaccgcggtt

SEQ ID NO: 268 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFTLEWHSYPMGHQVCVEEIDALRDWMQARFTAV

SEQ ID NO: 269 - DNA, 693 bp, Artificial Sequence
  Engineered Variants of Esterase  from  Xanthomonas campestris
atgccgagccgtgtgacgggtcgctgcattacgttagacgtgattgaacgtgaaaccggtccaaacccccaatgggccgtgatttggctgcatggcttgggtgctgacggtagtgactttgcaccgatggttccggaactggtccgtccacaatggccagcattacgcttcgtgtttcctcacgcgccgattcgcccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgcaggagaacaaagtgcacaggcattgcaagcattaggtttcgcgcttgaatggcatagctacccgatgggccatcaagtgtgctgggaggaaatcgatgcccttcgtgattggatgcaggcccgcttcaccgcggtt

SEQ ID NO: 270 - protein, 231 aa, Artificial Sequence
  Engineered Variants of Esterase  from  Xanthomonas campestris
MPSRVTGRCITLDVIERETGPNPQWAVIWLHGLGADGSDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFALEWHSYPMGHQVCWEEIDALRDWMQARFTAV

SEQ ID NO: 271 - DNA, 693 bp, Artificial Sequence
  Engineered Variants of Esterase  from  Xanthomonas campestris
atgccgagccccgtgactggtcgaactattgagccggacgtgattgaacgtgaaaccggtccaaacccccaatgggccgtgatttggctgcatggcttgggtgctgatggttctgactttgcaccgatggttccggaactggtccgtccagactggccagcgttacgcttcgtgtttcctcacgcgccgattcgtccgatcacgatctggaatggcctgcgcatgcgtggttggtacgacatccaggggatggacttcgcgcaacgtgcggataaggtgggtattgcggagagtgttgcacaagttgaagccctgattgctaacgaacaagcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcacaagcattgcaagcattaggtttcacgcttgaatggcatagctacccgatgggccatcaagtgtgcgtagaggaaatcgatgcccttcgtgattggatgcaagctcgcttcaccgcggtt

SEQ ID NO: 272 - protein, 231 aa, Artificial Sequence
  Engineered Variants of Esterase  from  Xanthomonas campestris
MPSPVTGRTIEPDVIERETGPNPQWAVIWLHGLGADGSDFAPMVPELVRPDWPALRFVFPHAPIRPITIWNGLRMRGWYDIQGMDFAQRADKVGIAESVAQVEALIANEQARGIAPDRILLAGFSQGGAVTLAVGLQRRVPLAGLIALSTYLPDPAAAASQLQPGALAQPLFMAHGSADLVVPYRAGEQSAQALQALGFTLEWHSYPMGHQVCVEEIDALRDWMQARFTAV

SEQ ID NO: 273 - DNA, 693 bp, Artificial Sequence
  Engineered Variants of Esterase  from  Xanthomonas campestris
atgccgagccccgtgactggtcgatgcattatcttagacgtgattgaacgtgaaaccggtccaaacccccaatgggccgtgatttggctgcatggcttgggtagtgatggttctgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcgcgcttgaatggcatagctacccgatgggccatcaagtgtgctgggaggaaatcgatgcccttcgtgattggatgcaggcccgcttcaccgcggtt

SEQ ID NO: 274 - protein, 231 aa, Artificial Sequence
  Engineered Variants of Esterase  from  Xanthomonas campestris
MPSPVTGRCIILDVIERETGPNPQWAVIWLHGLGSDGSDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFALEWHSYPMGHQVCWEEIDALRDWMQARFTAV

SEQ ID NO: 275 - DNA, 693 bp, Artificial Sequence
  Engineered Variants of Esterase  from  Xanthomonas campestris
atgccgagccccgtgactggtcgatgtattatgttagatgtgattgaacgtgaaaccggtccaaacccccaatggacggtgatttggctgcatggcttgggtgctgatggttctgactttgcaccgatggttccggaactggtccgtccacaatggccagcattacgcttcgtgtttcctcacgcgccgattcgtccgatcacgatcaacaatggcgttcgcatgcgtggttggtacgacatcgtggggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcaccgcggtt

SEQ ID NO: 276 - protein, 231 aa, Artificial Sequence
  Engineered Variants of Esterase  from  Xanthomonas campestris
MPSPVTGRCIMLDVIERETGPNPQWTVIWLHGLGADGSDFAPMVPELVRPQWPALRFVFPHAPIRPITINNGVRMRGWYDIVGMDFAQRADKVGIAESVAQVEALIANEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFTAV

SEQ ID NO: 277 - DNA, 693 bp, Artificial Sequence
  Engineered Variants of Esterase  from  Xanthomonas campestris
atgccgagccccgtgactggtcgatgcattatgttagacgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgtgcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcacccttgaatggcatagctacccgatgggccatcaagtgtgcgtagaggaaatcgatgcacttcgtgattggatgcaggctcgcttcaccgcggtt

SEQ ID NO: 278 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIALSTYLPDPAAAASQLQPGALAQPLFMAHGSADLVVPYRAGEQSAQALQALGFTLEWHSYPMGHQVCVEEIDALRDWMQARFTAV

SEQ ID NO: 279 - DNA, 693 bp, Artificial Sequence
  Engineered Variants of Esterase  from  Xanthomonas campestris
atgccgagccccgtgactggtcgatgtattatgttagatgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatcaacaatggcgttcgcatgcgtggttggtacgacatcgtggggatggacttcgcgcaacgtgcggataaggtgggtattgcggagagtgttgcacaagttgaagccctgattgctaatgaacagatgcgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcaccgcggtt

SEQ ID NO: 280 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITINNGVRMRGWYDIVGMDFAQRADKVGIAESVAQVEALIANEQMRGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFTAV

SEQ ID NO: 281 - DNA, 693 bp, Artificial Sequence
  Engineered Variants of Esterase  from  Xanthomonas campestris
atgccgagccccgtgactggtcgatgtattatgttagatgtgattgaacgtgaaaccggtccaaacccccaatggggggtgatttggctgcatggcttgggtgctgatggttctgactttgcaccgatggttccggaactggtccgtccacaatggccagcattacgcttcgtgtttcctcacgcgccgattcgtccgatcacgatcaacaatggcgttcgcatgcgtggttggtacgacatcgtggggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcaccgcggtt

SEQ ID NO: 282 - protein, 231 aa, Artificial Sequence
  Engineered Variants of Esterase  from  Xanthomonas campestris
MPSPVTGRCIMLDVIERETGPNPQWGVIWLHGLGADGSDFAPMVPELVRPQWPALRFVFPHAPIRPITINNGVRMRGWYDIVGMDFAQRADKVGIAESVAQVEALIANEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFTAV

SEQ ID NO: 283 - DNA, 693 bp, Artificial Sequence
  Engineered Variants of Esterase  from  Xanthomonas campestris
atgccgagccccgtgactggtcgatgtattatgttagatgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatcaacaatggcgttcgcatgcgtggttggtacgacatcgtggggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcagtggcgcttcaccgcggtt

SEQ ID NO: 284 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITINNGVRMRGWYDIVGMDFAQRADKVGIAESVAQVEALIANEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQWRFTAV

SEQ ID NO: 285 - DNA, 693 bp, Artificial Sequence
  Engineered Variants of Esterase  from  Xanthomonas campestris
atgccgcgccccgtgactggtggctgtattatgttagatgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatcgtagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcatggcggtt

SEQ ID NO: 286 - protein, 231 aa, Artificial Sequence
  Engineered Variants of Esterase  from  Xanthomonas campestris
MPRPVTGGCIMLDVIERETGPNPQWAVIWLHGLGADGSDFAPMVPELVRPQWPALRFVFPHAPIRPITIWNGVRMRGWYDIVGMDFAQRADKVGIAESVAQVEALIANEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFMAV

SEQ ID NO: 287 - DNA, 693 bp, Artificial Sequence
  Engineered Variants of Esterase  from  Xanthomonas campestris
atgccgagccccgtgactggtcgatgcattgagttagacgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggctcgcttcaccgcggtt

SEQ ID NO: 288 - protein, 231 aa, Artificial Sequence
  Engineered Variants of Esterase  from  Xanthomonas campestris
MPSPVTGRCIELDVIERETGPNPQWAVIWLHGLGADGSDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFTLEWHSYPMGHQVCVEEIDALRDWMQARFTAV

SEQ ID NO: 289 - DNA, 693 bp, Artificial Sequence
  Engineered Variants of Esterase  from  Xanthomonas campestris
atgccgagccccgtgactggtcgatgcattatcttagacgtgattgaacgtgaaaccggtccaaacccccaatgggccgtgatttggctgcatggcttgggtggggatggttctgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcgcgcttgaatggcatagctacccgatgggccatcaagtgtgctgggaggaaatcgatgcccttcgtgattggatgcaggcccgcttcaccgcggtt

SEQ ID NO: 290 - protein, 231 aa, Artificial Sequence
  Engineered Variants of Esterase  from  Xanthomonas campestris
MPSPVTGRCIILDVIERETGPNPQWAVIWLHGLGGDGSDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFALEWHSYPMGHQVCWEEIDALRDWMQARFTAV

SEQ ID NO: 291 - DNA, 693 bp, Artificial Sequence
  Engineered Variants of Esterase  from  Xanthomonas campestris
atgccgagccccgtgactggtcgatgcattgagttagacgtgattgaacgtgaaaccggtccaaacccccaatgggccgtgatttggctgcatggcttgggtgctgatggttctgactttgcaccgatggttccggaactggtccgtccagactggccatcgttacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcacccttgaatggcatagctacccgatgggccatcaagtgtgcgtagaggaaatcgatgcacttcgtgattggatgcaggctcgcttcaccgcggtt

SEQ ID NO: 292 - protein, 231 aa, Artificial Sequence
  Engineered Variants of Esterase  from  Xanthomonas campestris
MPSPVTGRCIELDVIERETGPNPQWAVIWLHGLGADGSDFAPMVPELVRPDWPSLRFVFPHAPIRPITIWNGVRMRGWYDIQGMDFAQRADKVGIAESVAQVEALIANEQARGIAPDRILLAGFSQGGAVTLAVGLQRRVPLAGLIALSTYLPDPAAAASQLQPGALAQPLFMAHGSADLVVPYRAGEQSAQALQALGFTLEWHSYPMGHQVCVEEIDALRDWMQARFTAV

SEQ ID NO: 293 - DNA, 693 bp, Artificial Sequence
  Engineered Variants of Esterase  from  Xanthomonas campestris
atgccgagccccgtgactggtcgatgtattatgttagatgtgattgaacaggaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcgcgcttgaatggcatagctacccgatgggccatcaagtgtgctgggaggaaatcgatgcccttcgtgattggatgcaggcccgcttcaccgcggtt

SEQ ID NO: 294 - protein, 231 aa, Artificial Sequence
  Engineered Variants of Esterase  from  Xanthomonas campestris
MPSPVTGRCIMLDVIEQETGPNPQWAVIWLHGLGADGSDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFALEWHSYPMGHQVCWEEIDALRDWMQARFTAV

SEQ ID NO: 295 - DNA, 693 bp, Artificial Sequence
  Engineered Variants of Esterase  from  Xanthomonas campestris
atgccgagccccgtgactggtcgatgcattgagttagacgtgattgaagtggaaaccggtccaaacccccaatgggccgtgatttggctgcatggcttgggtgctgatggttctgactttgcaccgatggttccggaactggtcagtccacaatggccagcgttacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttccatcttgaatggcatagctacccgatgggccatcaagtgtgcgtagaggaaatcgatgcacttcgtgattggatgcaggctcgcttcaccgcggtt

SEQ ID NO: 296 - protein, 231 aa, Artificial Sequence
  Engineered Variants of Esterase  from  Xanthomonas campestris
MPSPVTGRCIELDVIEVETGPNPQWAVIWLHGLGADGSDFAPMVPELVSPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFHLEWHSYPMGHQVCVEEIDALRDWMQARFTAV

SEQ ID NO: 297 - DNA, 693 bp, Artificial Sequence
  Engineered Variants of Esterase  from  Xanthomonas campestris
atgccgagccgtgtgccgggtcgctgcattatcttagacgtgattgaacgtgaaaccggtccaaacccccaatgggccgtgatttggctgcatggcttgggtgctaacggtagtgactttgcaccgatggttccggaactggtccgtccacaatggccagcattacgcttcgtgtttcctcacgcgccgattcgcccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgcaggagaacaaagtgcacaggcattgcaagcattaggtttcgcgcttgaatggcatagctacccgatgggccatcaagtgtgctgggaggaaatcgatgcccttcgtgattggatgcaggcccgcttcatggcggtt

SEQ ID NO: 298 - protein, 231 aa, Artificial Sequence
  Engineered Variants of Esterase  from  Xanthomonas campestris
MPSRVPGRCIILDVIERETGPNPQWAVIWLHGLGANGSDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFALEWHSYPMGHQVCWEEIDALRDWMQARFMAV

SEQ ID NO: 299 - DNA, 693 bp, Artificial Sequence
  Engineered Variants of Esterase  from  Xanthomonas campestris
atgcctagacctgtaacaggtcgttgtatgattttggatgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatccaggggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcaccgcggtt

SEQ ID NO: 300 - protein, 231 aa, Artificial Sequence
  Engineered Variants of Esterase  from  Xanthomonas campestris
MPRPVTGRCMILDVIERETGPNPQWAVIWLHGLGADGSDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFTLEWHSYPMGHQVCVEEIDALRDWMQARFTAV

SEQ ID NO: 301 - DNA, 693 bp, Artificial Sequence
  Engineered Variants of Esterase  from  Xanthomonas campestris
atgccgagccccgtgactggtcgatgcattatgttagacgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctcatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcacccttgaatggcatagctacccgatgggccatcaagtgtgcgtagaggaaatcgatgcacttcgtgattggatgcaggctcgcttcaccgcggtt

SEQ ID NO: 302 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITIWNGVRMRGWYDIQGMDFAQRADKVGIAESVAQVEALIAHEQARGIAPDRILLAGFSQGGAVTLAVGLQRRVPLAGLIAMSTYLPDPAAAASQLQPGALAQPLFMAHGSADLVVPYRAGEQSAQALQALGFTLEWHSYPMGHQVCVEEIDALRDWMQARFTAV

SEQ ID NO: 303 - DNA, 693 bp, Artificial Sequence
  Engineered Variants of Esterase  from  Xanthomonas campestris
atgccgagccccgtgactggtcgatgtattatgttagatgtgattgaatgggaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatcaacaatggcgttcgcatgcgtggttggtacgacatcgtggggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcaccgcggtt

SEQ ID NO: 304 - protein, 231 aa, Artificial Sequence
  Engineered Variants of Esterase  from  Xanthomonas campestris
MPSPVTGRCIMLDVIEWETGPNPQWAVIWLHGLGADGSDFAPMVPELVRPQWPALRFVFPHAPIRPITINNGVRMRGWYDIVGMDFAQRADKVGIAESVAQVEALIANEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFTAV

SEQ ID NO: 305 - DNA, 693 bp, Artificial Sequence
  Engineered Variants of Esterase  from  Xanthomonas campestris
atgccgagccccgtgactggtcgatgtattatgttagatgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatcgtggggatggacttcgcgcaacgtgcggataaggtgggtattgcggagagtcgcgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcatggcggtt

SEQ ID NO: 306 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITIWNGVRMRGWYDIVGMDFAQRADKVGIAESRAQVEALIANEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFMAV

SEQ ID NO: 307 - DNA, 693 bp, Artificial Sequence
  Engineered Variants of Esterase  from  Xanthomonas campestris
atgccgagccctgtgacgggtcgctgcattatgttagacgtgattgaacgtgaaaccggtccaaacccccaatgggccgtgatttggctgcatggcttgggtgctaacggtagtgactttgcaccgatggttccggaactggtccgtccacaatggccagcattacgcttcgtgtttcctcacgcgccgattcgcccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcgcgcttgaatggcatagctacccgatgggccatcaagtgtgctgggaggaaatcgatgcccttcgtgattggatgcaggcccgcttcaccgcggtt

SEQ ID NO: 308 - protein, 231 aa, Artificial Sequence
  Engineered Variants of Esterase  from  Xanthomonas campestris
MPSPVTGRCIMLDVIERETGPNPQWAVIWLHGLGANGSDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFALEWHSYPMGHQVCWEEIDALRDWMQARFTAV

SEQ ID NO: 309 - DNA, 693 bp, Artificial Sequence
  Engineered Variants of Esterase  from  Xanthomonas campestris
atgccgagccccgtgactggtcgctgtattatgttagaagtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatcgtagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcacggcggtt

SEQ ID NO: 310 - protein, 231 aa, Artificial Sequence
  Engineered Variants of Esterase  from  Xanthomonas campestris
MPSPVTGRCIMLEVIERETGPNPQWAVIWLHGLGADGSDFAPMVPELVRPQWPALRFVFPHAPIRPITIWNGVRMRGWYDIVGMDFAQRADKVGIAESVAQVEALIANEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFTAV

SEQ ID NO: 311 - DNA, 693 bp, Artificial Sequence
  Engineered Variants of Esterase  from  Xanthomonas campestris
atgccgagccccgtgactggtcgatgtattatgttagatgtgattgaacgtgaaaccggtccaaacccccaatgggccgtgatttggctgcatggcttgggtgctgatggttctgactttgggccgatggttccggaactggtccgtccacaatggccagcattacgcttcgtgtttcctcacgcgccgattcgtccgatcacgatcaacaatggcgttcgcatgcgtggttggtacgacatcgtggggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcaccgcggtt

SEQ ID NO: 312 - protein, 231 aa, Artificial Sequence
  Engineered Variants of Esterase  from  Xanthomonas campestris
MPSPVTGRCIMLDVIERETGPNPQWAVIWLHGLGADGSDFGPMVPELVRPQWPALRFVFPHAPIRPITINNGVRMRGWYDIVGMDFAQRADKVGIAESVAQVEALIANEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFTAV

SEQ ID NO: 313 - DNA, 693 bp, Artificial Sequence
  Engineered Variants of Esterase  from  Xanthomonas campestris
atgccgagccccgtgactggtcgctgtattacgttagatgtgattgaacgtgaaaccgggccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgatttttaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcacggcggtt

SEQ ID NO: 314 - protein, 231 aa, Artificial Sequence
  Engineered Variants of Esterase  from  Xanthomonas campestris
MPSPVTGRCITLDVIERETGPNPQWAVIWLHGLGADGSDFAPMVPELVRPQWPALRFVFPHAPIRPITIWNGVRMRGWYDIQGMDFAQRADKVGIAESVAQVEALIFNEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFTAV

SEQ ID NO: 315 - DNA, 693 bp, Artificial Sequence
  Engineered Variants of Esterase  from  Xanthomonas campestris
atgccgagccccgtgactggtcgatgcattatgttagacgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctcatgaaatggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcacccttgaatggcatagctacccgatgggccatcaagtgtgcgtagaggaaatcgatcatcttcgtgattggatgcaggctcgcttcaccgcggtt

SEQ ID NO: 316 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITIWNGVRMRGWYDIQGMDFAQRADKVGIAESVAQVEALIAHEMARGIAPDRILLAGFSQGGAVTLAVGLQRRVPLAGLIAMSTYLPDPAAAASQLQPGALAQPLFMAHGSADLVVPYRAGEQSAQALQALGFTLEWHSYPMGHQVCVEEIDHLRDWMQARFTAV

SEQ ID NO: 317 - DNA, 693 bp, Artificial Sequence
  Engineered Variants of Esterase  from  Xanthomonas campestris
atgccgagccccgtgactggtcgatgcattgagttagacgtgattgaacgtgaaaccggtccaaacccccaatgggccgtgatttggctgcatggcttgggtgctgatggttctgactttgcaccgatggttccggaactggtccgtccacaatggccatcgttacgcttcgtgtttcctcacgcgccgattcgtccgatcacgatctggaatggcgtgcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttccatcttgaatggcatagctacccgatgggccatcaagtgtgcgtagaggaaatcgatgcccttcgtgattggatgcaggctcgcttcaccgcggtt

SEQ ID NO: 318 - protein, 231 aa, Artificial Sequence
  Engineered Variants of Esterase  from  Xanthomonas campestris
MPSPVTGRCIELDVIERETGPNPQWAVIWLHGLGADGSDFAPMVPELVRPQWPSLRFVFPHAPIRPITIWNGVRMRGWYDIQGMDFAQRADKVGIAESVAQVEALIANEQARGIAPDRILLAGFSQGGAVTLAVGLQRRVPLAGLIALSTYLPDPAAAASQLQPGALAQPLFMAHGSADLVVPYRAGEQSAQALQALGFHLEWHSYPMGHQVCVEEIDALRDWMQARFTAV

SEQ ID NO: 319 - DNA, 693 bp, Artificial Sequence
  Engineered Variants of Esterase  from  Xanthomonas campestris
atgccgagccccgtgactggtcgatgcattatgttagacgtgattgaacgtgaaaccggtccaaacccccaatgggccgtgatttggctgcatggcttgggtgctgatggttctgactttgcaccgatggttccggaactggtcagtccagactggccatcgttacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaaatggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaagcattgcaagcattaggtttcacgcttgaatggcatagctacccgatgggccatcaagtgtgcgtagaggaaatcgatgcacttcgtgattggatgcaggctcgcttcaccgcggtt

SEQ ID NO: 320 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVSPDWPSLRFVFPHAPIRPITIWNGVRMRGWYDIQGMDFAQRADKVGIAESVAQVEALIANEMARGIAPDRILLAGFSQGGAVTLAVGLQRRVPLAGLIAMSTYLPDPAAAASQLQPGALAQPLFMAHGSADLVVPYRAGEQSAQALQALGFTLEWHSYPMGHQVCVEEIDALRDWMQARFTAV

SEQ ID NO: 321 - DNA, 693 bp, Artificial Sequence
  Engineered Variants of Esterase  from  Xanthomonas campestris
atgccgagccgtgtgacgggtggctgcattacgttagacgtgattgaacgtgaaaccggtccaaacccccaatgggccgtgatttggctgcatggcttgggtgctaacggttatgactttgcaccgatggttccggaactggtccgtccacaatggccagcattacgcttcgtgtttcctcacgcgccgattcgcccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgcaggagaacaaagtgcacaggcattgcaagcattaggtttcgcgcttgaatggcatagctacccgatgggccatcaagtgtgctgggaggaaatcgatgcccttcgtgattggatgcaggcccgcttcatggcggtt

SEQ ID NO: 322 - protein, 231 aa, Artificial Sequence
  Engineered Variants of Esterase  from  Xanthomonas campestris
MPSRVTGGCITLDVIERETGPNPQWAVIWLHGLGANGYDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFALEWHSYPMGHQVCWEEIDALRDWMQARFMAV

SEQ ID NO: 323 - DNA, 693 bp, Artificial Sequence
  Engineered Variants of Esterase  from  Xanthomonas campestris
atgccgagccccgtgactggtcgatgtattatgttagatgtgattgaacgtgaaaccggtccaaacccccaatgggccgtgatttggctgcatggcttgggtgctgatggttctgacttttttccgatggttccggaactggtccgtccacaatggccagcattacgcttcgtgtttcctcacgcgccgattcgtccgatcacgatcaacaatggcgttcgcatgcgtggttggtacgacatcgtggggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcaccgcggtt

SEQ ID NO: 324 - protein, 231 aa, Artificial Sequence
  Engineered Variants of Esterase  from  Xanthomonas campestris
MPSPVTGRCIMLDVIERETGPNPQWAVIWLHGLGADGSDFFPMVPELVRPQWPALRFVFPHAPIRPITINNGVRMRGWYDIVGMDFAQRADKVGIAESVAQVEALIANEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFTAV

SEQ ID NO: 325 - DNA, 693 bp, Artificial Sequence
  Engineered Variants of Esterase  from  Xanthomonas campestris
atgccgagccctgtgacgggtggctgcattacgttagacgtgattgaacgtgaaaccggtccaaacccccaatgggccgtgatttggctgcatggcttgggtgctgacggtagtgactttgcaccgatagttccggaactggtccgtccacaatggccagcattacgcttcgtgtttcctcacgcgccgattcgcccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgcaggagaacaaagtgcacaggcattgcaagcattaggtttcgcgcttgaatggcatagctacccgatgggccatcaagtgtgctgggaggaaatcgatgcccttcgtgattggatgcaggcccgcttcacggcggtt

SEQ ID NO: 326 - protein, 231 aa, Artificial Sequence
  Engineered Variants of Esterase  from  Xanthomonas campestris
MPSPVTGGCITLDVIERETGPNPQWAVIWLHGLGADGSDFAPIVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFALEWHSYPMGHQVCWEEIDALRDWMQARFTAV

SEQ ID NO: 327 - DNA, 693 bp, Artificial Sequence
  Engineered Variants of Esterase  from  Xanthomonas campestris
atgccgagccccgtgactggtcgatgcattatgttagacgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcaatggcattgcaagcattaggtttcacccttgaatggcatagctacccgatgggccatcaagtgtgcgtagaggaaatcgatcatcttcgtgattggatgcaggctcgcttcaccgcggtt

SEQ ID NO: 328 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAMALQALGFTLEWHSYPMGHQVCVEEIDHLRDWMQARFTAV

SEQ ID NO: 329 - DNA, 693 bp, Artificial Sequence
  Engineered Variants of Esterase  from  Xanthomonas campestris
atgccgagccccgtgactggtcgatgtattatgttagatgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatcaacaatggcgttcgcatgcgtggttggtacgacatcgtggggatggacttcgcgcaacgtgcggataaggtgggtattgcggagagtgttgcacaagttgaagccctgatttttaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcaccgcggtt

SEQ ID NO: 330 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITINNGVRMRGWYDIVGMDFAQRADKVGIAESVAQVEALIFNEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFTAV

SEQ ID NO: 331 - DNA, 693 bp, Artificial Sequence
  Engineered Variants of Esterase  from  Xanthomonas campestris
atgccgagccccgtgactggtcgatgcattatgttagacgtgattgaacgtgaaaccggtccaaacccccaatgggccgtgatttggctgcatggcttgggtgctgatggttctgactttgcaccgatggttccggaactggtccgtccacaatggccagcgttacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttccatcttgaatggcatagctacccgatgggccatcaagtgtgcgtagaggaaatcgatcatcttcgtgattggatgcaggctcgcttcaccgcggtt

SEQ ID NO: 332 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIALSTYLPDPAAAASQLQPGALAQPLFMAHGSADLVVPYRAGEQSAQALQALGFHLEWHSYPMGHQVCVEEIDHLRDWMQARFTAV

SEQ ID NO: 333 - DNA, 693 bp, Artificial Sequence
  Engineered Variants of Esterase  from  Xanthomonas campestris
atgccgagccccgtgactggtcgatgtattatgttagatgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatcgtggggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcaccgcggtt

SEQ ID NO: 334 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITIWNGVRMRGWYDIVGMDFAQRADKVGIAESVAQVEALIANEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFTAV

SEQ ID NO: 335 - DNA, 693 bp, Artificial Sequence
  Engineered Variants of Esterase  from  Xanthomonas campestris
atgccgagccccgtgactggtcgaactattgggctggacgtgattgaacgtgaaaccggtccaaacccccaatgggccgtgatttggctgcatggcttgggtgctgatggttctgactttgcaccgatggttccggaactggtccgtccagactggccatcgttacgcttcgtgtttcctcacgcgccgattcgtccgatcacgatctggaatggcctgcgcatgcgtggttggtacgacatccaggggatggacttcgcgcaacgtgcggataaggtgggtattgcggagagtgttgcacaagttgaagccctgattgctaacgaaatggcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcacaagcattgcaagcattaggtttcacgcttgaatggcatagctacccgatgggccatcaagtgtgcgtagaggaaatcgatgcccttcgtgattggatgcaggctcgcttcaccgcggtt

SEQ ID NO: 336 - protein, 231 aa, Artificial Sequence
  Engineered Variants of Esterase  from  Xanthomonas campestris
MPSPVTGRTIGLDVIERETGPNPQWAVIWLHGLGADGSDFAPMVPELVRPDWPSLRFVFPHAPIRPITIWNGLRMRGWYDIQGMDFAQRADKVGIAESVAQVEALIANEMARGIAPDRILLAGFSQGGAVTLAVGLQRRVPLAGLIALSTYLPDPAAAASQLQPGALAQPLFMAHGSADLVVPYRAGEQSAQALQALGFTLEWHSYPMGHQVCVEEIDALRDWMQARFTAV

SEQ ID NO: 337 - DNA, 693 bp, Artificial Sequence
  Engineered Variants of Esterase  from  Xanthomonas campestris
atgccgagccccgtgactggtcgatgtattatgttagatgtgattgaatcggaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcgcgcttgaatggcatagctacccgatgggccatcaagtgtgctgggaggaaatcgatgcccttcgtgattggatgcaggcccgcttcaccgcggtt

SEQ ID NO: 338 - protein, 231 aa, Artificial Sequence
  Engineered Variants of Esterase  from  Xanthomonas campestris
MPSPVTGRCIMLDVIESETGPNPQWAVIWLHGLGADGSDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFALEWHSYPMGHQVCWEEIDALRDWMQARFTAV

SEQ ID NO: 339 - DNA, 693 bp, Artificial Sequence
  Engineered Variants of Esterase  from  Xanthomonas campestris
atgccgagccccgtgactggtcgatgcattgagttagacgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgtgcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcacaagcattgcaagcattaggtttcacccttgaatggcatagctacccgatgggccatcaagtgtgcgtagaggaaatcgatgcacttcgtgattggatgcaggctcgcttcaccgcggtt

SEQ ID NO: 340 - protein, 231 aa, Artificial Sequence
  Engineered Variants of Esterase  from  Xanthomonas campestris
MPSPVTGRCIELDVIERETGPNPQWAVIWLHGLGADGSDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIALSTYLPDPAAAASQLQPGALAQPLFMAHGSADLVVPYRAGEQSAQALQALGFTLEWHSYPMGHQVCVEEIDALRDWMQARFTAV

SEQ ID NO: 341 - DNA, 693 bp, Artificial Sequence
  Engineered Variants of Esterase  from  Xanthomonas campestris
atgccgagccccgtgactggtcgatgtattatgttagatgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatcgtggggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagaagctgccgccagtcaactgcaaccgggtgcattagcccagccattgttcatggcacatggatcggcagaccccgttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcaccgcggtt

SEQ ID NO: 342 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITIWNGVRMRGWYDIVGMDFAQRADKVGIAESVAQVEALIANEQARGIAPDRILLAGFSQGGAVTLAVGLQRRVPLAGLIAMSTYLPDPEAAASQLQPGALAQPLFMAHGSADPVVPYRAGEQSAQALQALGFTLEWHSYPMGHQVCVEEIDALRDWMQARFTAV

SEQ ID NO: 343 - DNA, 693 bp, Artificial Sequence
  Engineered Variants of Esterase  from  Xanthomonas campestris
atgccgagccccgtgactggtcgctgtattacgttagatgtgattgaacgtgaaaccgggccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatcgtagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcacggcggtt

SEQ ID NO: 344 - protein, 231 aa, Artificial Sequence
  Engineered Variants of Esterase  from  Xanthomonas campestris
MPSPVTGRCITLDVIERETGPNPQWAVIWLHGLGADGSDFAPMVPELVRPQWPALRFVFPHAPIRPITIWNGVRMRGWYDIVGMDFAQRADKVGIAESVAQVEALIANEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFTAV

SEQ ID NO: 345 - DNA, 693 bp, Artificial Sequence
  Engineered Variants of Esterase  from  Xanthomonas campestris
atgccgagccccgtgactggtcgctgtattacgttagatgtgattgaacgtgaaaccgggccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcacggcggtt

SEQ ID NO: 346 - protein, 231 aa, Artificial Sequence
  Engineered Variants of Esterase  from  Xanthomonas campestris
MPSPVTGRCITLDVIERETGPNPQWAVIWLHGLGADGSDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFTAV

SEQ ID NO: 347 - DNA, 693 bp, Artificial Sequence
  Engineered Variants of Esterase  from  Xanthomonas campestris
atgccgagccccgtgactggtcgatgcattatcttagacgtgattgaacgtgaaaccggtccaaacccccaatgggccgtgatttggctgcatggcttgggtgctaacggttatgactttgcaccgatggttccggaactggtccgtccacaatggccagcattacgcttcgtgtttcctcacgcgccgattatcccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgcaggagaacaaagtgcacaggcattgcaagcattaggtttcgcgcttgaatggcatagctacccgatgggccatcaagtgtgctgggaggaaatcgatgcccttcgtgattggatgcaggcccgcttcatggcggtt

SEQ ID NO: 348 - protein, 231 aa, Artificial Sequence
  Engineered Variants of Esterase  from  Xanthomonas campestris
MPSPVTGRCIILDVIERETGPNPQWAVIWLHGLGANGYDFAPMVPELVRPQWPALRFVFPHAPIIPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFALEWHSYPMGHQVCWEEIDALRDWMQARFMAV

SEQ ID NO: 349 - DNA, 693 bp, Artificial Sequence
  Engineered Variants of Esterase  from  Xanthomonas campestris
atgccgagccccgtgactggtcgatgtattatgttagatgtgattgaacgtgaaaccggtccaaacccccaatgggccgtgatttggctgcatggcttgggtgctgatggttcttggtttgcaccgatggttccggaactggtccgtccacaatggccagcattacgcttcgtgtttcctcacgcgccgattcgtccgatcacgatcaacaatggcgttcgcatgcgtggttggtacgacatcgtggggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcaccgcggtt

SEQ ID NO: 350 - protein, 231 aa, Artificial Sequence
  Engineered Variants of Esterase  from  Xanthomonas campestris
MPSPVTGRCIMLDVIERETGPNPQWAVIWLHGLGADGSWFAPMVPELVRPQWPALRFVFPHAPIRPITINNGVRMRGWYDIVGMDFAQRADKVGIAESVAQVEALIANEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFTAV

SEQ ID NO: 351 - DNA, 693 bp, Artificial Sequence
  Engineered Variants of Esterase  from  Xanthomonas campestris
atgccgcgccccgtgactggtggctgtattacgttagatgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatcgtggggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcatggcggtt

SEQ ID NO: 352 - protein, 231 aa, Artificial Sequence
  Engineered Variants of Esterase  from  Xanthomonas campestris
MPRPVTGGCITLDVIERETGPNPQWAVIWLHGLGADGSDFAPMVPELVRPQWPALRFVFPHAPIRPITIWNGVRMRGWYDIVGMDFAQRADKVGIAESVAQVEALIANEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFMAV

SEQ ID NO: 353 - DNA, 693 bp, Artificial Sequence
  Engineered Variants of Esterase  from  Xanthomonas campestris
atgccgagccccgtgactggtcgatgtattatgttagatgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatcaacaatggcgttcgcatgcgtggttggtacgacatcgtggggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaatcgttaggtttcacccttgaatggcatagctacccgatgggccatcaagtgtgcgtagaggaaatcgatgcccttcgtgattggatgcaggcccgcttcaccgcggtt

SEQ ID NO: 354 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITINNGVRMRGWYDIVGMDFAQRADKVGIAESVAQVEALIANEQARGIAPDRILLAGFSQGGAVTLAVGLQRRVPLAGLIAMSTYLPDPAAAASQLQPGALAQPLFMAHGSADPVVPYRAGEQSAQALQSLGFTLEWHSYPMGHQVCVEEIDALRDWMQARFTAV

SEQ ID NO: 355 - DNA, 693 bp, Artificial Sequence
  Engineered Variants of Esterase  from  Xanthomonas campestris
atgccgagccctgtgacgggtggctgcattacgttagacgtgattgaacgtgaaaccggtccaaacccccaatgggccgtgatttggctgcatggcttgggtgctgacggttatgactttgcaccgatggttccggaactggtccgtccacaatggccagcattacgcttcgtgtttcctcacgcgccgattcgcccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgcaggagaacaaagtgcacaggcattgcaagcattaggtttcgcgcttgaatggcatagctacccgatgggccatcaagtgtgctgggaggaaatcgatgcccttcgtgattggatgcaggcccgcttcatggcggtt

SEQ ID NO: 356 - protein, 231 aa, Artificial Sequence
  Engineered Variants of Esterase  from  Xanthomonas campestris
MPSPVTGGCITLDVIERETGPNPQWAVIWLHGLGADGYDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFALEWHSYPMGHQVCWEEIDALRDWMQARFMAV

SEQ ID NO: 357 - DNA, 693 bp, Artificial Sequence
  Engineered Variants of Esterase  from  Xanthomonas campestris
atgccgagccccgtgactggtcgatgtattatgttagatgtgattgaacgtgaaaccggtccaaacccccaatgggccgtgattgggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatcgtggggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcaccgcggtt

SEQ ID NO: 358 - protein, 231 aa, Artificial Sequence
  Engineered Variants of Esterase  from  Xanthomonas campestris
MPSPVTGRCIMLDVIERETGPNPQWAVIGLHGLGADGSDFAPMVPELVRPQWPALRFVFPHAPIRPITIWNGVRMRGWYDIVGMDFAQRADKVGIAESVAQVEALIANEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFTAV

SEQ ID NO: 359 - DNA, 693 bp, Artificial Sequence
  Engineered Variants of Esterase  from  Xanthomonas campestris
atgccgagccccgtgactggtcgatgtattatgttagatgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatcgtggggatggacttcgcgcaacgtgcggataaggtgggtattgcggagagtcgcgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcaccgcggtt

SEQ ID NO: 360 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITIWNGVRMRGWYDIVGMDFAQRADKVGIAESRAQVEALIANEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFTAV

SEQ ID NO: 361 - DNA, 693 bp, Artificial Sequence
  Engineered Variants of Esterase  from  Xanthomonas campestris
atgccgagccccgtgactggtggctgtattacgttagatgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatcgtggggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcatggcggtt

SEQ ID NO: 362 - protein, 231 aa, Artificial Sequence
  Engineered Variants of Esterase  from  Xanthomonas campestris
MPSPVTGGCITLDVIERETGPNPQWAVIWLHGLGADGSDFAPMVPELVRPQWPALRFVFPHAPIRPITIWNGVRMRGWYDIVGMDFAQRADKVGIAESVAQVEALIANEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFMAV

SEQ ID NO: 363 - DNA, 693 bp, Artificial Sequence
  Engineered Variants of Esterase  from  Xanthomonas campestris
atgccgagccccgtgactggtcgatgtattatgttagatgtgattgaacgtgaaaccggtccaaacccccaatgggccgtgatttggctgcatggcttgggtgctgatggttctgactttgcaccgatggttcgtgaactggtccgtccacaatggccagccttacgcttcgtgtttcctcacgcgccgattcgtccgatcacgatctggaatggcgttcgcatgcgtggttggtacgacatcgtggggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccggttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcaccgcggtt

SEQ ID NO: 364 - protein, 231 aa, Artificial Sequence
  Engineered Variants of Esterase  from  Xanthomonas campestris
MPSPVTGRCIMLDVIERETGPNPQWAVIWLHGLGADGSDFAPMVRELVRPQWPALRFVFPHAPIRPITIWNGVRMRGWYDIVGMDFAQRADKVGIAESVAQVEALIANEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFTAV

SEQ ID NO: 365 - DNA, 693 bp, Artificial Sequence
  Engineered Variants of Esterase  from  Xanthomonas campestris
atgccgagccccgtgactggtggctgtattatgttagatgtgattgaacgtgaaaccgggccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcatggcggtt

SEQ ID NO: 366 - protein, 231 aa, Artificial Sequence
  Engineered Variants of Esterase  from  Xanthomonas campestris
MPSPVTGGCIMLDVIERETGPNPQWAVIWLHGLGADGSDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFMAV

SEQ ID NO: 367 - DNA, 693 bp, Artificial Sequence
  Engineered Variants of Esterase  from  Xanthomonas campestris
atgccgcgccccgtgactggtcgctgtattatgttagatgtgattgaacgtgaaaccgggccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcaccgcggtt

SEQ ID NO: 368 - protein, 231 aa, Artificial Sequence
  Engineered Variants of Esterase  from  Xanthomonas campestris
MPRPVTGRCIMLDVIERETGPNPQWAVIWLHGLGADGSDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFTAV

SEQ ID NO: 369 - DNA, 693 bp, Artificial Sequence
  Engineered Variants of Esterase  from  Xanthomonas campestris
atgccgcgccccgtgactggtcgctgtattacgttagatgtgattgaacgtgaaaccgggccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatcgtggggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcatggcggtt

SEQ ID NO: 370 - protein, 231 aa, Artificial Sequence
  Engineered Variants of Esterase  from  Xanthomonas campestris
MPRPVTGRCITLDVIERETGPNPQWAVIWLHGLGADGSDFAPMVPELVRPQWPALRFVFPHAPIRPITIWNGVRMRGWYDIVGMDFAQRADKVGIAESVAQVEALIANEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFMAV

SEQ ID NO: 371 - DNA, 693 bp, Artificial Sequence
  Engineered Variants of Esterase  from  Xanthomonas campestris
atgccgagccccgtgactggtcgatgtattatggtggatgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcgcgcttgaatggcatagctacccgatgggccatcaagtgtgctgggaggaaatcgatgcccttcgtgattggatgcaggcccgcttcaccgcggtt

SEQ ID NO: 372 - protein, 231 aa, Artificial Sequence
  Engineered Variants of Esterase  from  Xanthomonas campestris
MPSPVTGRCIMVDVIERETGPNPQWAVIWLHGLGADGSDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFALEWHSYPMGHQVCWEEIDALRDWMQARFTAV

SEQ ID NO: 373 - DNA, 693 bp, Artificial Sequence
  Engineered Variants of Esterase  from  Xanthomonas campestris
atgccgagccctgtgacgggtcgctgcattacgttagacgtgattgaacgtgaaaccggtccaaacccccaatgggccgtgatttggctgcatggcttgggtgctaacggttatgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgcaggagaacaaagtgcacaggcattgcaagcattaggtttcgcgcttgaatggcatagctacccgatgggccatcaagtgtgctgggaggaaatcgatgcccttcgtgattggatgcaggcccgcttcatggcggtt

SEQ ID NO: 374 - protein, 231 aa, Artificial Sequence
  Engineered Variants of Esterase  from  Xanthomonas campestris
MPSPVTGRCITLDVIERETGPNPQWAVIWLHGLGANGYDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFALEWHSYPMGHQVCWEEIDALRDWMQARFMAV

SEQ ID NO: 375 - DNA, 693 bp, Artificial Sequence
  Engineered Variants of Esterase  from  Xanthomonas campestris
atgccaagtcctgttactggtcgctggatgctgctggatgtgattgaacgtgaaaccggtccaaacccccaatgggccgtgatttggctgcatggcttgggtgcttcgggttctgactttgcaccgatggttccggaactggtccgtccacaatggccagcattacgcttcgtgtttcctcacgcgccgattcgtccgatcacgatcaacaatggcgttcgcatgcgtggttggtacgacatcgtggggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagcttcccggccggccatcaagtgtgcgtagaggaaatcgatgcccttcgtgattggatgcaggcccgcttcaccgcggtt

SEQ ID NO: 376 - protein, 231 aa, Artificial Sequence
  Engineered Variants of Esterase  from  Xanthomonas campestris
MPSPVTGRWMLLDVIERETGPNPQWAVIWLHGLGASGSDFAPMVPELVRPQWPALRFVFPHAPIRPITINNGVRMRGWYDIVGMDFAQRADKVGIAESVAQVEALIANEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSFPAGHQVCVEEIDALRDWMQARFTAV

SEQ ID NO: 377 - DNA, 693 bp, Artificial Sequence
  Engineered Variants of Esterase  from  Xanthomonas campestris
atgccgagccccgtgactggtggctgtattacgttagaagtgattgaacgtgaaaccgggccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatcgtagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcaccgcggtt

SEQ ID NO: 378 - protein, 231 aa, Artificial Sequence
  Engineered Variants of Esterase  from  Xanthomonas campestris
MPSPVTGGCITLEVIERETGPNPQWAVIWLHGLGADGSDFAPMVPELVRPQWPALRFVFPHAPIRPITIWNGVRMRGWYDIVGMDFAQRADKVGIAESVAQVEALIANEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFTAV

SEQ ID NO: 379 - DNA, 693 bp, Artificial Sequence
  Engineered Variants of Esterase  from  Xanthomonas campestris
atgccgagccccgtgactggtcgatgtattatgttagatgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatcgtggggatggacttcgcgcaacgtgcggatcgtgtgggtattgcggagagtgttgcacaagttgaagccctgattgctaatgaacaggcacgcgggattgctccagatcgtattctgctggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcaccgcggtt

SEQ ID NO: 380 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITIWNGVRMRGWYDIVGMDFAQRADRVGIAESVAQVEALIANEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFTAV

SEQ ID NO: 381 - DNA, 693 bp, Artificial Sequence
  Engineered Variants of Esterase  from  Xanthomonas campestris
atgccgagccccgtgactggtcgatgcattatcttagacgtgattgaacgtgaaaccggtccaaacccccaatgggccgtgatttggctgcatggcttgggtgcttctggttctgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcgcgcttgaatggcatagctacccgatgggccatcaagtgtgctgggaggaaatcgatgcccttcgtgattggatgcaggcccgcttcaccgcggtt

SEQ ID NO: 382 - protein, 231 aa, Artificial Sequence
  Engineered Variants of Esterase  from  Xanthomonas campestris
MPSPVTGRCIILDVIERETGPNPQWAVIWLHGLGASGSDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFALEWHSYPMGHQVCWEEIDALRDWMQARFTAV

SEQ ID NO: 383 - DNA, 693 bp, Artificial Sequence
  Engineered Variants of Esterase  from  Xanthomonas campestris
atgccgagccccgtgactggtcgatgcattatcttagacgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctagggaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcgcgcttgaatggcatagctacccgatgggccatcaagtgtgctgggaggaaatcgatgcccttcgtgattggatgcaggcccgcttcaccgcggtt

SEQ ID NO: 384 - protein, 231 aa, Artificial Sequence
  Engineered Variants of Esterase  from  Xanthomonas campestris
MPSPVTGRCIILDVIERETGPNPQWAVIWLHGLGADGSDFAPMVPELVRPQWPALRFVFPHAPIRPITIWNGVRMRGWYDIQGMDFAQRADKVGIAESVAQVEALIAREQARGIAPDRILLAGFSQGGAVTLAVGLQRRVPLAGLIAMSTYLPDPAAAASQLQPGALAQPLFMAHGSADLVVPYRAGEQSAQALQALGFALEWHSYPMGHQVCWEEIDALRDWMQARFTAV

SEQ ID NO: 385 - DNA, 693 bp, Artificial Sequence
  Engineered Variants of Esterase  from  Xanthomonas campestris
atgccgagccccgtgactggtcgctgtattatgttagatgtgattgaacgtgaaaccgggccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcacggcggtt

SEQ ID NO: 386 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFTAV

SEQ ID NO: 387 - DNA, 693 bp, Artificial Sequence
  Engineered Variants of Esterase  from  Xanthomonas campestris
atgccgagccccgtgactggtcgatgcattatcttagacgtgattgaacgtgaaaccggtccaaacccccaatgggccgtgatttggctgcatggcttgggtgctaatggttctgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagagttaggtttcacccttgaatggcatagctacccgatgggccatcaagtgtgctgggaggaaatcgatgcccttcgtgattggatgcaggcccgcttcaccgcggtt

SEQ ID NO: 388 - protein, 231 aa, Artificial Sequence
  Engineered Variants of Esterase  from  Xanthomonas campestris
MPSPVTGRCIILDVIERETGPNPQWAVIWLHGLGANGSDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQELGFTLEWHSYPMGHQVCWEEIDALRDWMQARFTAV

SEQ ID NO: 389 - DNA, 693 bp, Artificial Sequence
  Engineered Variants of Esterase  from  Xanthomonas campestris
atgccgagccgtgtgacgggtcgctgcattacgttagacgtgattgaacgtgaaaccggtccaaacccccaatgggccgtgatttggctgcatggcttgggtgctaacggtagtgactttgcaccgatggttccggaactggtccgtccacaatggccagcattacgcttcgtgtttcctcacgcgccgattcgcccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgcaggagaacaaagtgcacaggcattgcaagcattaggtttcgcgcttgaatggcatagctacccgatgggccatcaagtgtgctgggaggaaatcgatgcccttcgtgattggatgcaggcccgcttcatggcggtt

SEQ ID NO: 390 - protein, 231 aa, Artificial Sequence
  Engineered Variants of Esterase  from  Xanthomonas campestris
MPSRVTGRCITLDVIERETGPNPQWAVIWLHGLGANGSDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFALEWHSYPMGHQVCWEEIDALRDWMQARFMAV

SEQ ID NO: 391 - DNA, 693 bp, Artificial Sequence
  Engineered Variants of Esterase  from  Xanthomonas campestris
atgccgagccccgtgactggtcgatgcattatcttagacgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggcggggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcgcgcttgaatggcatagctacccgatgggccatcaagtgtgctgggaggaaatcgatgcccttcgtgattggatgcaggcccgcttcaccgcggtt

SEQ ID NO: 392 - protein, 231 aa, Artificial Sequence
  Engineered Variants of Esterase  from  Xanthomonas campestris
MPSPVTGRCIILDVIERETGPNPQWAVIWLHGLGADGSDFAPMVPELVRPQWPALRFVFPHAPIRPITIWRGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFALEWHSYPMGHQVCWEEIDALRDWMQARFTAV

SEQ ID NO: 393 - DNA, 693 bp, Artificial Sequence
  Engineered Variants of Esterase  from  Xanthomonas campestris
atgccgagccccgtgactggtcgatgtattatgttagatgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatcaacaatggcgttcgcatgcgtggttggtacgacatcgtggggatggacttcgcgcaacgtgcggataaggtgggtattgcggagagtgttgcacaagttgaagccctgattgctaatgaagtggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcaccgcggtt

SEQ ID NO: 394 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITINNGVRMRGWYDIVGMDFAQRADKVGIAESVAQVEALIANEVARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFTAV

SEQ ID NO: 395 - DNA, 693 bp, Artificial Sequence
  Engineered Variants of Esterase  from  Xanthomonas campestris
atgccaagtcctgttactggtcgctggatgctgctggatgtgattgaacgtgaaaccggtccaaaccctacctgggccgtgatttggctgcatggcttgggtgctgacggttctgactttgcaccgatggttccggaactggtccgtccacaatggccagcattacgcttcgtgtttcctcacgcgccgattcgtccgatcacgatcaacaatggcgttcgcatgcgtggttggtacgacatcgtggggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgaccttcgtgattggatgcaggcccgcttcaccgcggtt

SEQ ID NO: 396 - protein, 231 aa, Artificial Sequence
  Engineered Variants of Esterase  from  Xanthomonas campestris
MPSPVTGRWMLLDVIERETGPNPTWAVIWLHGLGADGSDFAPMVPELVRPQWPALRFVFPHAPIRPITINNGVRMRGWYDIVGMDFAQRADKVGIAESVAQVEALIANEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDDLRDWMQARFTAV

SEQ ID NO: 397 - DNA, 693 bp, Artificial Sequence
  Engineered Variants of Esterase  from  Xanthomonas campestris
atgccgagccccgtgactggtcgctgtattacgttagatgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatcgtggggatggacttcgcgcaacgtgcggataaggtgggtattgcggagagtgttgcacaagttgaagccctgatttttaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcaccgcggtt

SEQ ID NO: 398 - protein, 231 aa, Artificial Sequence
  Engineered Variants of Esterase  from  Xanthomonas campestris
MPSPVTGRCITLDVIERETGPNPQWAVIWLHGLGADGSDFAPMVPELVRPQWPALRFVFPHAPIRPITIWNGVRMRGWYDIVGMDFAQRADKVGIAESVAQVEALIFNEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFTAV

SEQ ID NO: 399 - DNA, 693 bp, Artificial Sequence
  Engineered Variants of Esterase  from  Xanthomonas campestris
atgccgcgccccgtgactggtggctgtattacgttagatgtgattgaacgtgaaaccgggccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatcgtagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcacggcggtt

SEQ ID NO: 400 - protein, 231 aa, Artificial Sequence
  Engineered Variants of Esterase  from  Xanthomonas campestris
MPRPVTGGCITLDVIERETGPNPQWAVIWLHGLGADGSDFAPMVPELVRPQWPALRFVFPHAPIRPITIWNGVRMRGWYDIVGMDFAQRADKVGIAESVAQVEALIANEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFTAV

SEQ ID NO: 401 - DNA, 693 bp, Artificial Sequence
  Engineered Variants of Esterase  from  Xanthomonas campestris
atgccgcgccccgtgcctggtcgatgtattatgttagatgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatcgtggggatggacttcgcgcaacgtgcggataaggtgggtattgcggagagtcgcgcacaagttgaagccctgattgcgaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcacggcggtt

SEQ ID NO: 402 - protein, 231 aa, Artificial Sequence
  Engineered Variants of Esterase  from  Xanthomonas campestris
MPRPVPGRCIMLDVIERETGPNPQWAVIWLHGLGADGSDFAPMVPELVRPQWPALRFVFPHAPIRPITIWNGVRMRGWYDIVGMDFAQRADKVGIAESRAQVEALIANEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFTAV

SEQ ID NO: 403 - DNA, 693 bp, Artificial Sequence
  Engineered Variants of Esterase  from  Xanthomonas campestris
atgccgcgccccgtgactggtggctgtattacgttagaagtgattgaacgtgaaaccgggccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatcgtagggatggacttcgcgcaacgtgcggataaggtgggtattgcggagagtgttgcacaagttgaagccctgatttttaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcacggcggtt

SEQ ID NO: 404 - protein, 231 aa, Artificial Sequence
  Engineered Variants of Esterase  from  Xanthomonas campestris
MPRPVTGGCITLEVIERETGPNPQWAVIWLHGLGADGSDFAPMVPELVRPQWPALRFVFPHAPIRPITIWNGVRMRGWYDIVGMDFAQRADKVGIAESVAQVEALIFNEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFTAV

SEQ ID NO: 405 - DNA, 693 bp, Artificial Sequence
  Engineered Variants of Esterase  from  Xanthomonas campestris
atgccgagccccgtgactggtcgaactattgggagcgacgtgattgaacgtgaaaccggtccaaacccccaatgggccgtgatttggctgcatggcttgggtgctgatggttctgactttgcaccgatggttccggaactggtcagtccagactggccagcgttacgcttcgtgtttcctcacgcgccgattcgtccgatcacgatctggaatggcatgcgcatgcgtggttggtacgacatccaagggatggacttcgcgcaacgtgcggataaggtgggtattgcggagagtgttgcacaagttgaagccctgattgctaacgaacaagcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttccatcttgaatggcatagctacccgatgggccatcaagtgtgcgtagaggaaatcgatgcccttcgtgattggatgtcggctcgcttcaccgcggtt

SEQ ID NO: 406 - protein, 231 aa, Artificial Sequence
  Engineered Variants of Esterase  from  Xanthomonas campestris
MPSPVTGRTIGSDVIERETGPNPQWAVIWLHGLGADGSDFAPMVPELVSPDWPALRFVFPHAPIRPITIWNGMRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFHLEWHSYPMGHQVCVEEIDALRDWMSARFTAV

SEQ ID NO: 407 - DNA, 693 bp, Artificial Sequence
  Engineered Variants of Esterase  from  Xanthomonas campestris
atgccgcgccccgtgactggtggctgtattatgttagaagtgattgaacgtgaaaccgggccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcatggcggtt

SEQ ID NO: 408 - protein, 231 aa, Artificial Sequence
  Engineered Variants of Esterase  from  Xanthomonas campestris
MPRPVTGGCIMLEVIERETGPNPQWAVIWLHGLGADGSDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFMAV

SEQ ID NO: 409 - DNA, 693 bp, Artificial Sequence
  Engineered Variants of Esterase  from  Xanthomonas campestris
atgccgagccccgtgactggtcgatgtattatgttagatgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatcaacaatggcgttcgcatgcgtggttggtacgacatcgtggggatggacttcgcgcaacgtgcggataaggtgggtatttttgagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcaccgcggtt

SEQ ID NO: 410 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITINNGVRMRGWYDIVGMDFAQRADKVGIFESVAQVEALIANEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFTAV

SEQ ID NO: 411 - DNA, 693 bp, Artificial Sequence
  Engineered Variants of Esterase  from  Xanthomonas campestris
atgccgagccgtgtgacgggtcgctgcattacgttagacgtgattgaacgtgaaaccggtccaaacccccaatgggccgtgatttggctgcatggcttgggtgctaacggtagtgactttgcaccgatggttccggaactggtccgtccacaatggccagcattacgcttcgtgtttcctcacgcgccgattcgcccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgcaggagaacaaagtgcacaggcattgcaagcattaggtttcgcgcttgaatggcatagctacccgatgggccatcaagtgtgctgggaggaaatcgatgcccttcgtgattggatgcaggcccgcttcacggcggtt

SEQ ID NO: 412 - protein, 231 aa, Artificial Sequence
  Engineered Variants of Esterase  from  Xanthomonas campestris
MPSRVTGRCITLDVIERETGPNPQWAVIWLHGLGANGSDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFALEWHSYPMGHQVCWEEIDALRDWMQARFTAV

SEQ ID NO: 413 - DNA, 693 bp, Artificial Sequence
  Engineered Variants of Esterase  from  Xanthomonas campestris
atgccgagccccgtgactggtcgatgtattatgttagatgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatcaacaatggcgttcgcatgcgtggttggtacgacatcgtggggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagaggttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcaccgcggtt

SEQ ID NO: 414 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITINNGVRMRGWYDIVGMDFAQRADKVGIAESVAQVEALIANEQARGIAPDRILLAGFSQGGAVTLEVGLQRRVPLAGLIAMSTYLPDPAAAASQLQPGALAQPLFMAHGSADPVVPYRAGEQSAQALQALGFTLEWHSYPMGHQVCVEEIDALRDWMQARFTAV

SEQ ID NO: 415 - DNA, 693 bp, Artificial Sequence
  Engineered Variants of Esterase  from  Xanthomonas campestris
atgccgagccccgtgactggtcgatgcattgagttagacgtgattgaatgcgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgtgcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcacgcttgaatggcatagctacccgatgggccatcaagtgtgcgtagaggaaatcgatcatcttcgtgattggatgcaggctcgcttcaccgcggtt

SEQ ID NO: 416 - protein, 231 aa, Artificial Sequence
  Engineered Variants of Esterase  from  Xanthomonas campestris
MPSPVTGRCIELDVIECETGPNPQWAVIWLHGLGADGSDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIALSTYLPDPAAAASQLQPGALAQPLFMAHGSADLVVPYRAGEQSAQALQALGFTLEWHSYPMGHQVCVEEIDHLRDWMQARFTAV

SEQ ID NO: 417 - DNA, 693 bp, Artificial Sequence
  Engineered Variants of Esterase  from  Xanthomonas campestris
atgccgagccccgtgactggtcgatgcattgagctggacgtgattgaacgtgaaaccggtccaaacccccaatgggccgtgatttggctgcatggcttgggtgctgatggttctgactttgcaccgatggttccggaactggtcagtccagactggccatcgttacgcttcgtgtttcctcacgcgccgattcgtccgatcacgatctggaatggcgttcgcatgcgtggttggtacgacatcgcggggatggacttcgcgcaacgtgcggataaggtgggtattgcggagagtgttgcacaagttgaagccctgattgctaacgaaatggcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcacgcttgaatggcatagctacccgatgggccatcaagtgtgcgtagaggaaatcgatgcccttcgtgattggatgcaggctcgcttcaccgcggtt

SEQ ID NO: 418 - protein, 231 aa, Artificial Sequence
  Engineered Variants of Esterase  from  Xanthomonas campestris
MPSPVTGRCIELDVIERETGPNPQWAVIWLHGLGADGSDFAPMVPELVSPDWPSLRFVFPHAPIRPITIWNGVRMRGWYDIAGMDFAQRADKVGIAESVAQVEALIANEMARGIAPDRILLAGFSQGGAVTLAVGLQRRVPLAGLIALSTYLPDPAAAASQLQPGALAQPLFMAHGSADLVVPYRAGEQSAQALQALGFTLEWHSYPMGHQVCVEEIDALRDWMQARFTAV

SEQ ID NO: 419 - DNA, 693 bp, Artificial Sequence
  Engineered Variants of Esterase  from  Xanthomonas campestris
atgccgcgccccgtgactggtggctgtattatgttagatgtgattgaacgtgaaaccgggccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcatggcggtt

SEQ ID NO: 420 - protein, 231 aa, Artificial Sequence
  Engineered Variants of Esterase  from  Xanthomonas campestris
MPRPVTGGCIMLDVIERETGPNPQWAVIWLHGLGADGSDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFMAV

SEQ ID NO: 421 - DNA, 693 bp, Artificial Sequence
  Engineered Variants of Esterase  from  Xanthomonas campestris
atgccgcgccccgtgactggtggctgtattatgttagatgtgattgaacgtgaaaccgggccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcacggcggtt

SEQ ID NO: 422 - protein, 231 aa, Artificial Sequence
  Engineered Variants of Esterase  from  Xanthomonas campestris
MPRPVTGGCIMLDVIERETGPNPQWAVIWLHGLGADGSDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFTAV

SEQ ID NO: 423 - DNA, 693 bp, Artificial Sequence
  Engineered Variants of Esterase  from  Xanthomonas campestris
atgccgagccctgtgacgggtggctgcattacgttagacgtgattgaacgtgaaaccggtccaaacccccaatgggccgtgatttggctgcatggcttgggtgctaacggttatgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgcaggagaacaaagtgcacaggcattgcaagcattaggtttcgcgcttgaatggcatagctacccgatgggccatcaagtgtgctgggaggaaatcgatgcccttcgtgattggatgcaggcccgcttcacggcggtt

SEQ ID NO: 424 - protein, 231 aa, Artificial Sequence
  Engineered Variants of Esterase  from  Xanthomonas campestris
MPSPVTGGCITLDVIERETGPNPQWAVIWLHGLGANGYDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFALEWHSYPMGHQVCWEEIDALRDWMQARFTAV

SEQ ID NO: 425 - DNA, 693 bp, Artificial Sequence
  Engineered Variants of Esterase  from  Xanthomonas campestris
atgccgagccccgtgactggtggctgtattacgttagaagtgattgaacgtgaaaccgggccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcacggcggtt

SEQ ID NO: 426 - protein, 231 aa, Artificial Sequence
  Engineered Variants of Esterase  from  Xanthomonas campestris
MPSPVTGGCITLEVIERETGPNPQWAVIWLHGLGADGSDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFTAV

SEQ ID NO: 427 - DNA, 693 bp, Artificial Sequence
  Engineered Variants of Esterase  from  Xanthomonas campestris
atgccgagccccgtgactggtcgaactattatgctggacgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcctgcgcatgcgtggttggtacgacatccaagggatggacttcgcgcaacgtgcggataaggtgggtattgcggagagtgttgcacaagttgaagccctgattgctcacgaaatggcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggctcgcttcaccgcggtt

SEQ ID NO: 428 - protein, 231 aa, Artificial Sequence
  Engineered Variants of Esterase  from  Xanthomonas campestris
MPSPVTGRTIMLDVIERETGPNPQWAVIWLHGLGADGSDFAPMVPELVRPQWPALRFVFPHAPIRPITIWNGLRMRGWYDIQGMDFAQRADKVGIAESVAQVEALIAHEMARGIAPDRILLAGFSQGGAVTLAVGLQRRVPLAGLIALSTYLPDPAAAASQLQPGALAQPLFMAHGSADLVVPYRAGEQSAQALQALGFTLEWHSYPMGHQVCVEEIDALRDWMQARFTAV

SEQ ID NO: 429 - DNA, 693 bp, Artificial Sequence
  Engineered Variants of Esterase  from  Xanthomonas campestris
atgccgagccccgtgactggtcgatgcattatcttagacgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgtttcgcaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcgcgcttgaatggcatagctacccgatgggccatcaagtgtgctgggaggaaatcgatgcccttcgtgattggatgcaggcccgcttcaccgcggtt

SEQ ID NO: 430 - protein, 231 aa, Artificial Sequence
  Engineered Variants of Esterase  from  Xanthomonas campestris
MPSPVTGRCIILDVIERETGPNPQWAVIWLHGLGADGSDFAPMVPELVRPQWPALRFVFPHAPIRPITIWNGVRMRGWYDIQGMDFAQRADKVGIAESVSQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFALEWHSYPMGHQVCWEEIDALRDWMQARFTAV

SEQ ID NO: 431 - DNA, 693 bp, Artificial Sequence
  Engineered Variants of Esterase  from  Xanthomonas campestris
atgccgagccccgtgactggtcgatgcattatcttagacgtgattgaacgtgaaaccggtccaaacccccaatgggccgtgatttggctgcatggcttgggtgctgatggttctgacgttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcgcgcttgaatggcatagctacccgatgggccatcaagtgtgctgggaggaaatcgatgcccttcgtgattggatgcaggcccgcttcaccgcggtt

SEQ ID NO: 432 - protein, 231 aa, Artificial Sequence
  Engineered Variants of Esterase  from  Xanthomonas campestris
MPSPVTGRCIILDVIERETGPNPQWAVIWLHGLGADGSDVAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFALEWHSYPMGHQVCWEEIDALRDWMQARFTAV

SEQ ID NO: 433 - DNA, 693 bp, Artificial Sequence
  Engineered Variants of Esterase  from  Xanthomonas campestris
atgccgagccctgtgacgggtcgctgcattacgttagacgtgattgaacgtgaaaccggtccaaacccccaatgggccgtgatttggctgcatggcttgggtgctaacggtagtgactttgcaccgatggttccggaactggtccgtccacaatggccagcattacgcttcgtgtttcctcacgcgccgattcgcccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgcaggagaacaaagtgcacaggcattgcaagcattaggtttcgcgcttgaatggcatagctacccgatgggccatcaagtgtgctgggaggaaatcgatgcccttcgtgattggatgcaggcccgcttcatggcggtt

SEQ ID NO: 434 - protein, 231 aa, Artificial Sequence
  Engineered Variants of Esterase  from  Xanthomonas campestris
MPSPVTGRCITLDVIERETGPNPQWAVIWLHGLGANGSDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFALEWHSYPMGHQVCWEEIDALRDWMQARFMAV

SEQ ID NO: 435 - DNA, 693 bp, Artificial Sequence
  Engineered Variants of Esterase  from  Xanthomonas campestris
atgccgagccccgtgactggtcgatgtattatgttagatgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatcgtggggatggacttcgcgcaacgtgcggataaggtgggtattgcggagagtgtagcacaagttgaagccctgattttcaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcatggcggtt

SEQ ID NO: 436 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITIWNGVRMRGWYDIVGMDFAQRADKVGIAESVAQVEALIFNEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFMAV

SEQ ID NO: 437 - DNA, 693 bp, Artificial Sequence
  Engineered Variants of Esterase  from  Xanthomonas campestris
atgccgagccccgtgactggtcgctgtattatgttagatgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgatttttaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcatggcggtt

SEQ ID NO: 438 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITIWNGVRMRGWYDIQGMDFAQRADKVGIAESVAQVEALIFNEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFMAV

SEQ ID NO: 439 - DNA, 693 bp, Artificial Sequence
  Engineered Variants of Esterase  from  Xanthomonas campestris
atgccgcgccccgtgactggtggctgtattatgttagaagtgattgaacgtgaaaccgggccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgatttttaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcacggcggtt

SEQ ID NO: 440 - protein, 231 aa, Artificial Sequence
  Engineered Variants of Esterase  from  Xanthomonas campestris
MPRPVTGGCIMLEVIERETGPNPQWAVIWLHGLGADGSDFAPMVPELVRPQWPALRFVFPHAPIRPITIWNGVRMRGWYDIQGMDFAQRADKVGIAESVAQVEALIFNEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFTAV

SEQ ID NO: 441 - DNA, 693 bp, Artificial Sequence
  Engineered Variants of Esterase  from  Xanthomonas campestris
atgccgagccccgtgactggtcgctgtattatgttagatgtgattgaacgtgaaaccgggccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatcgtagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcatggcggtt

SEQ ID NO: 442 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITIWNGVRMRGWYDIVGMDFAQRADKVGIAESVAQVEALIANEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFMAV

SEQ ID NO: 443 - DNA, 693 bp, Artificial Sequence
  Engineered Variants of Esterase  from  Xanthomonas campestris
atgccgagccccgtgactggtcgatgcattatcttagacgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatcgtggggatggacttcgtgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcgcgcttgaatggcatagctacccgatgggccatcaagtgtgctgggaggaaatcgatgcccttcgtgattggatgcaggcccgcttcaccgcggtt

SEQ ID NO: 444 - protein, 231 aa, Artificial Sequence
  Engineered Variants of Esterase  from  Xanthomonas campestris
MPSPVTGRCIILDVIERETGPNPQWAVIWLHGLGADGSDFAPMVPELVRPQWPALRFVFPHAPIRPITIWNGVRMRGWYDIVGMDFVQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFALEWHSYPMGHQVCWEEIDALRDWMQARFTAV

SEQ ID NO: 445 - DNA, 693 bp, Artificial Sequence
  Engineered Variants of Esterase  from  Xanthomonas campestris
atgccgagaccagttacggggcgatgcataatattagaggtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatcaacaatggcgttcgcatgcgtggttggtacgacatccaggggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcaccgcggtt

SEQ ID NO: 446 - protein, 231 aa, Artificial Sequence
  Engineered Variants of Esterase  from  Xanthomonas campestris
MPRPVTGRCIILEVIERETGPNPQWAVIWLHGLGADGSDFAPMVPELVRPQWPALRFVFPHAPIRPITINNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFTAV

SEQ ID NO: 447 - DNA, 693 bp, Artificial Sequence
  Engineered Variants of Esterase  from  Xanthomonas campestris
atgccgagccccgtgactggtcgatgtattatgttagatgtgattgaacgtgaaaccggtccaaacccccaatgggccgtgatttggctgcatggcttgggtgctgatccgtctgactttgcaccgatggttccggaactggtccgtccacaatggccagcattacgcttcgtgtttcctcacgcgccgattcgtccgatcacgatcaacaatggcgttcgcatgcgtggttggtacgacatcgtggggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcaccgcggtt

SEQ ID NO: 448 - protein, 231 aa, Artificial Sequence
  Engineered Variants of Esterase  from  Xanthomonas campestris
MPSPVTGRCIMLDVIERETGPNPQWAVIWLHGLGADPSDFAPMVPELVRPQWPALRFVFPHAPIRPITINNGVRMRGWYDIVGMDFAQRADKVGIAESVAQVEALIANEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFTAV

SEQ ID NO: 449 - DNA, 693 bp, Artificial Sequence
  Engineered Variants of Esterase  from  Xanthomonas campestris
atgccgcgccccgtgactggtggctgtattacgttagaagtgattgaacgtgaaaccgggccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgatttttaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcatggcggtt

SEQ ID NO: 450 - protein, 231 aa, Artificial Sequence
  Engineered Variants of Esterase  from  Xanthomonas campestris
MPRPVTGGCITLEVIERETGPNPQWAVIWLHGLGADGSDFAPMVPELVRPQWPALRFVFPHAPIRPITIWNGVRMRGWYDIQGMDFAQRADKVGIAESVAQVEALIFNEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFMAV

SEQ ID NO: 451 - DNA, 693 bp, Artificial Sequence
  Engineered Variants of Esterase  from  Xanthomonas campestris
atgccgagccgcgtgcctggtcgatgtattatgttagatgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcatggcggtt

SEQ ID NO: 452 - protein, 231 aa, Artificial Sequence
  Engineered Variants of Esterase  from  Xanthomonas campestris
MPSRVPGRCIMLDVIERETGPNPQWAVIWLHGLGADGSDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFMAV

SEQ ID NO: 453 - DNA, 693 bp, Artificial Sequence
  Engineered Variants of Esterase  from  Xanthomonas campestris
atgccgagccccgtgactggtcgatgtattatgttagatgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatcaacaatggcgttcgcatgcgtggttggtacgacatcgtggggatggacttcgcgcaacgtgcggataaggtgggtattgcggagagtgttgcacaagttgaagccctgattgctaatgaacaggcaggggggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcaccgcggtt

SEQ ID NO: 454 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITINNGVRMRGWYDIVGMDFAQRADKVGIAESVAQVEALIANEQAGGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFTAV

SEQ ID NO: 455 - DNA, 693 bp, Artificial Sequence
  Engineered Variants of Esterase  from  Xanthomonas campestris
atgccgagccccgtgactggtcgaactattatgccggacgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatcgcggggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcacaagcattgcaagcattaggtttcacccttgaatggcatagctacccgatgggccatcaagtgtgcgtagaggaaatcgatgcccttcgtgattggatgtcggctcgcttcaccgcggtt

SEQ ID NO: 456 - protein, 231 aa, Artificial Sequence
  Engineered Variants of Esterase  from  Xanthomonas campestris
MPSPVTGRTIMPDVIERETGPNPQWAVIWLHGLGADGSDFAPMVPELVRPQWPALRFVFPHAPIRPITIWNGVRMRGWYDIAGMDFAQRADKVGIAESVAQVEALIANEQARGIAPDRILLAGFSQGGAVTLAVGLQRRVPLAGLIALSTYLPDPAAAASQLQPGALAQPLFMAHGSADLVVPYRAGEQSAQALQALGFTLEWHSYPMGHQVCVEEIDALRDWMSARFTAV

SEQ ID NO: 457 - DNA, 693 bp, Artificial Sequence
  Engineered Variants of Esterase  from  Xanthomonas campestris
atgccgagccccgtgactggtcgatgcattgggttagacgtgattgaacgtgaaaccggtccaaacccccaatgggccgtgatttggctgcatggcttgggtgctgatggttctgactttgcaccgatggttccggaactggtccgtccacaatggccatcgttacgcttcgtgtttcctcacgcgccgattcgtccgatcacgatctggaatggcgttcgcatgcgtggttggtacgacatccaagggatggacttcccgcaacgtgcggataaggtgggtattgcggagagtgttgcacaagttgaagccctgattgctcatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaagcattgcaagcattaggtttcacgcttgaatggcatagctacccgatgggccatcaagtgtgcgtagaggaaatcgatgcacttcgtgattggatgcaggctcgcttcaccgcggtt

SEQ ID NO: 458 - protein, 231 aa, Artificial Sequence
  Engineered Variants of Esterase  from  Xanthomonas campestris
MPSPVTGRCIGLDVIERETGPNPQWAVIWLHGLGADGSDFAPMVPELVRPQWPSLRFVFPHAPIRPITIWNGVRMRGWYDIQGMDFPQRADKVGIAESVAQVEALIAHEQARGIAPDRILLAGFSQGGAVTLAVGLQRRVPLAGLIAMSTYLPDPAAAASQLQPGALAQPLFMAHGSADLVVPYRAGEQSAQALQALGFTLEWHSYPMGHQVCVEEIDALRDWMQARFTAV

SEQ ID NO: 459 - DNA, 693 bp, Artificial Sequence
  Engineered Variants of Esterase  from  Xanthomonas campestris
atgccgagccccgtgactggtcgatgcattgagctggacgtgattgaacgtgaaaccggtccaaacccccaatgggccgtgatttggctgcatggcttgggtgctgatggttctgactttgcaccgatggttccggaactggtcagtccacagtggccagcgttacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaacgaaatggcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcacaagcattgcaagcattaggtttcacgcttgaatggcatagctacccgatgggccatcaagtgtgcgtagaggaaatcgatgcccttcgtgattggatgtcggctcgcttcaccgcggtt

SEQ ID NO: 460 - protein, 231 aa, Artificial Sequence
  Engineered Variants of Esterase  from  Xanthomonas campestris
MPSPVTGRCIELDVIERETGPNPQWAVIWLHGLGADGSDFAPMVPELVSPQWPALRFVFPHAPIRPITIWNGVRMRGWYDIQGMDFAQRADKVGIAESVAQVEALIANEMARGIAPDRILLAGFSQGGAVTLAVGLQRRVPLAGLIALSTYLPDPAAAASQLQPGALAQPLFMAHGSADLVVPYRAGEQSAQALQALGFTLEWHSYPMGHQVCVEEIDALRDWMSARFTAV

SEQ ID NO: 461 - DNA, 693 bp, Artificial Sequence
  Engineered Variants of Esterase  from  Xanthomonas campestris
atgccgagccccgtgactggtggctgtattacgttagatgtgattgaacgtgaaaccgggccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgatttttaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcatggcggtt

SEQ ID NO: 462 - protein, 231 aa, Artificial Sequence
  Engineered Variants of Esterase  from  Xanthomonas campestris
MPSPVTGGCITLDVIERETGPNPQWAVIWLHGLGADGSDFAPMVPELVRPQWPALRFVFPHAPIRPITIWNGVRMRGWYDIQGMDFAQRADKVGIAESVAQVEALIFNEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFMAV

SEQ ID NO: 463 - DNA, 693 bp, Artificial Sequence
  Engineered Variants of Esterase  from  Xanthomonas campestris
atgccgagccccgtgactggtcgatgtattatgttagatgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatcaacaatggcgttcgcatgcgtggttggtacgacatcgtggggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttatgggttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcaccgcggtt

SEQ ID NO: 464 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITINNGVRMRGWYDIVGMDFAQRADKVGIAESVAQVEALIANEQARGIAPDRILLAGFSQGGAVTLWVGLQRRVPLAGLIAMSTYLPDPAAAASQLQPGALAQPLFMAHGSADPVVPYRAGEQSAQALQALGFTLEWHSYPMGHQVCVEEIDALRDWMQARFTAV

SEQ ID NO: 465 - DNA, 693 bp, Artificial Sequence
  Engineered Variants of Esterase  from  Xanthomonas campestris
atgccgagccccgtgactggtcgaactattgggctggacgtgattgaacgtgaaaccggtccaaacccccaatgggccgtgatttggctgcatggcttgggtgctgatggttctgactttgcaccgatggttccggaactggtccgtccagactggccatcgttacgcttcgtgtttcctcacgcgccgattcgtccgatcacgatctggaatggcctgcgcatgcgtggttggtacgacatccaggggatggacttcgcgcaacgtgcggataaggtgggtattgcggagagtgttgcacaagttgaagccctgattgctcacgaacaagcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttccatcttgaatggcatagctacccgatgggccatcaagtgtgcgtagaggaaatcgatgcccttcgtgattggatgtcggctcgcttcaccgcggtt

SEQ ID NO: 466 - protein, 231 aa, Artificial Sequence
  Engineered Variants of Esterase  from  Xanthomonas campestris
MPSPVTGRTIGLDVIERETGPNPQWAVIWLHGLGADGSDFAPMVPELVRPDWPSLRFVFPHAPIRPITIWNGLRMRGWYDIQGMDFAQRADKVGIAESVAQVEALIAHEQARGIAPDRILLAGFSQGGAVTLAVGLQRRVPLAGLIAMSTYLPDPAAAASQLQPGALAQPLFMAHGSADLVVPYRAGEQSAQALQALGFHLEWHSYPMGHQVCVEEIDALRDWMSARFTAV

SEQ ID NO: 467 - DNA, 693 bp, Artificial Sequence
  Engineered Variants of Esterase  from  Xanthomonas campestris
atgccgagccccgtgactggtcgatgtattgagttagatgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcgcgcttgaatggcatagctacccgatgggccatcaagtgtgctgggaggaaatcgatgcccttcgtgattggatgcaggcccgcttcaccgcggtt

SEQ ID NO: 468 - protein, 231 aa, Artificial Sequence
  Engineered Variants of Esterase  from  Xanthomonas campestris
MPSPVTGRCIELDVIERETGPNPQWAVIWLHGLGADGSDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFALEWHSYPMGHQVCWEEIDALRDWMQARFTAV

SEQ ID NO: 469 - DNA, 693 bp, Artificial Sequence
  Engineered Variants of Esterase  from  Xanthomonas campestris
atgccgagccgcgtgactggtggctgtattacgttagaagtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgatttttaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcatggcggtt

SEQ ID NO: 470 - protein, 231 aa, Artificial Sequence
  Engineered Variants of Esterase  from  Xanthomonas campestris
MPSRVTGGCITLEVIERETGPNPQWAVIWLHGLGADGSDFAPMVPELVRPQWPALRFVFPHAPIRPITIWNGVRMRGWYDIQGMDFAQRADKVGIAESVAQVEALIFNEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFMAV

SEQ ID NO: 471 - DNA, 693 bp, Artificial Sequence
  Engineered Variants of Esterase  from  Xanthomonas campestris
atgccgagccccgtgactggtcgatgtattatgttagatgtgattgaacgtgaaaccggtccaaacccccaatgggccgtgatttggctgcatggcttgggtgctgatggttctgacttttcgccgatggttccggaactggtccgtccacaatggccagcattacgcttcgtgtttcctcacgcgccgattcgtccgatcacgatcaacaatggcgttcgcatgcgtggttggtacgacatcgtggggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcaccgcggtt

SEQ ID NO: 472 - protein, 231 aa, Artificial Sequence
  Engineered Variants of Esterase  from  Xanthomonas campestris
MPSPVTGRCIMLDVIERETGPNPQWAVIWLHGLGADGSDFSPMVPELVRPQWPALRFVFPHAPIRPITINNGVRMRGWYDIVGMDFAQRADKVGIAESVAQVEALIANEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFTAV

SEQ ID NO: 473 - DNA, 693 bp, Artificial Sequence
  Engineered Variants of Esterase  from  Xanthomonas campestris
atgccgagccctgtgacgggtcgctgcattacgttagacgtgattgaacgtgaaaccggtccaaacccccaatgggccgtgatttggctgcatggcttgggtgctgacggttatgactttgcaccgatggttccggaactggtccgtccacaatggccagcattacgcttcgtgtttcctcacgcgccgattcgcccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgctttggagaacaaagtgcacaggcattgcaagcattaggtttcgcgcttgaatggcatagctacccgatgggccatcaagtgtgctgggaggaaatcgatgcccttcgtgattggatgcaggcccgcttcacggcggtt

SEQ ID NO: 474 - protein, 231 aa, Artificial Sequence
  Engineered Variants of Esterase  from  Xanthomonas campestris
MPSPVTGRCITLDVIERETGPNPQWAVIWLHGLGADGYDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRFGEQSAQALQALGFALEWHSYPMGHQVCWEEIDALRDWMQARFTAV

SEQ ID NO: 475 - DNA, 693 bp, Artificial Sequence
  Engineered Variants of Esterase  from  Xanthomonas campestris
atgccgagccccgtgactggtcgatgtattatgttagatgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgatttttaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcacggcggtt

SEQ ID NO: 476 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITIWNGVRMRGWYDIQGMDFAQRADKVGIAESVAQVEALIFNEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFTAV

SEQ ID NO: 477 - DNA, 693 bp, Artificial Sequence
  Engineered Variants of Esterase  from  Xanthomonas campestris
atgccgagccccgtgactggtcgatgcattatcttagacgtgattgaacgtgaaaccggtccaaacccccaatgggccgtgatttggctgcatggcttgggtgctaacggttatgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcgcgcttgaatggcatagctacccgatgggccatcaagtgtgctgggaggaaatcgatgcccttcgtgattggatgcaggcccgcttcacggcggtt

SEQ ID NO: 478 - protein, 231 aa, Artificial Sequence
  Engineered Variants of Esterase  from  Xanthomonas campestris
MPSPVTGRCIILDVIERETGPNPQWAVIWLHGLGANGYDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFALEWHSYPMGHQVCWEEIDALRDWMQARFTAV

SEQ ID NO: 479 - DNA, 693 bp, Artificial Sequence
  Engineered Variants of Esterase  from  Xanthomonas campestris
atgccgagccgtgtgacgggtcgctgcattacgttagacgtgattgaacgtgaaaccggtccaaacccccaatgggccgtgatttggctgcatggcttgggtgctaacggtagtgactttgcaccgatggttccggaactggtccgtccacaatggccagcattacgcttcgtgtttcctcacgcgccgattatcccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgctttggagaacaaagtgcacaggcattgcaagcattaggtttcgcgcttgaatggcatagctacccgatgggccatcaagtgtgctgggaggaaatcgatgcccttcgtgattggatgcaggcccgcttcaccgcggtt

SEQ ID NO: 480 - protein, 231 aa, Artificial Sequence
  Engineered Variants of Esterase  from  Xanthomonas campestris
MPSRVTGRCITLDVIERETGPNPQWAVIWLHGLGANGSDFAPMVPELVRPQWPALRFVFPHAPIIPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRFGEQSAQALQALGFALEWHSYPMGHQVCWEEIDALRDWMQARFTAV

SEQ ID NO: 481 - DNA, 693 bp, Artificial Sequence
  Engineered Variants of Esterase  from  Xanthomonas campestris
atgccgagccccgtgactggtcgatgtattatgttagatgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgggccgattcgtccgatcacgatcaacaatggcgttcgcatgcgtggttggtacgacatcgtggggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcaccgcggtt

SEQ ID NO: 482 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHGPIRPITINNGVRMRGWYDIVGMDFAQRADKVGIAESVAQVEALIANEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFTAV

SEQ ID NO: 483 - DNA, 693 bp, Artificial Sequence
  Engineered Variants of Esterase  from  Xanthomonas campestris
atgccgagccccgtgactggtggctgtattatgttagatgtgattgaacgtgaaaccgggccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatcgtagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcacggcggtt

SEQ ID NO: 484 - protein, 231 aa, Artificial Sequence
  Engineered Variants of Esterase  from  Xanthomonas campestris
MPSPVTGGCIMLDVIERETGPNPQWAVIWLHGLGADGSDFAPMVPELVRPQWPALRFVFPHAPIRPITIWNGVRMRGWYDIVGMDFAQRADKVGIAESVAQVEALIANEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFTAV

SEQ ID NO: 485 - DNA, 693 bp, Artificial Sequence
  Engineered Variants of Esterase  from  Xanthomonas campestris
atgccgagccgtgtgacgggtcgctgcattatcttagacgtgattgaacgtgaaaccggtccaaacccccaatgggccgtgatttggctgcatggcttgggtgctaacggttatgactttgcaccgatggttccggaactggtccgtccacaatggccagcattacgcttcgtgtttcctcacgcgccgattcgcccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgcaggagaacaaagtgcacaggcattgcaagcattaggtttcgcgcttgaatggcatagctacccgatgggccatcaagtgtgctgggaggaaatcgatgcccttcgtgattggatgcaggcccgcttcatggcggtt

SEQ ID NO: 486 - protein, 231 aa, Artificial Sequence
  Engineered Variants of Esterase  from  Xanthomonas campestris
MPSRVTGRCIILDVIERETGPNPQWAVIWLHGLGANGYDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFALEWHSYPMGHQVCWEEIDALRDWMQARFMAV

SEQ ID NO: 487 - DNA, 693 bp, Artificial Sequence
  Engineered Variants of Esterase  from  Xanthomonas campestris
atgccgagccccgtgactggtcgaactattatgagcgacgtgattgaacgtgaaaccggtccaaacccccaatgggccgtgatttggctgcatggcttgggtgctgatggttctgactttgcaccgatggttccggaactggtccgtccagactggccatcgttacgcttcgtgtttcctcacgcgccgattcgtccgatcacgatctggaatggcgtgcgcatgcgtggttggtacgacatcgtggggatggacttcgcgcaacgtgcggataaggtgggtattgcggagagtgttgcacaagttgaagccctgattgctaacgaacaagcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcacgcttgaatggcatagctacccgatgggccatcaagtgtgcgtagaggaaatcgatgcccttcgtgattggatgtcggctcgcttcaccgcggtt

SEQ ID NO: 488 - protein, 231 aa, Artificial Sequence
  Engineered Variants of Esterase  from  Xanthomonas campestris
MPSPVTGRTIMSDVIERETGPNPQWAVIWLHGLGADGSDFAPMVPELVRPDWPSLRFVFPHAPIRPITIWNGVRMRGWYDIVGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFTLEWHSYPMGHQVCVEEIDALRDWMSARFTAV

SEQ ID NO: 489 - DNA, 693 bp, Artificial Sequence
  Engineered Variants of Esterase  from  Xanthomonas campestris
atgccgagccccgtgactggtcgatgcattatcttagacgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatcgctgggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcgcgcttgaatggcatagctacccgatgggccatcaagtgtgctgggaggaaatcgatgcccttcgtgattggatgcaggcccgcttcaccgcggtt

SEQ ID NO: 490 - protein, 231 aa, Artificial Sequence
  Engineered Variants of Esterase  from  Xanthomonas campestris
MPSPVTGRCIILDVIERETGPNPQWAVIWLHGLGADGSDFAPMVPELVRPQWPALRFVFPHAPIRPITIWNGVRMRGWYDIAGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFALEWHSYPMGHQVCWEEIDALRDWMQARFTAV

SEQ ID NO: 491 - DNA, 693 bp, Artificial Sequence
  Engineered Variants of Esterase  from  Xanthomonas campestris
atgccgagccccgtgactggtcgatgtattatgttagatgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatcaacaatggcgttcgcatgcgtggttggtacgacatcgtggggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatgaggtgtgcgtagaggaaatcgatgcccttcgtgattggatgcaggcccgcttcaccgcggtt

SEQ ID NO: 492 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITINNGVRMRGWYDIVGMDFAQRADKVGIAESVAQVEALIANEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHEVCVEEIDALRDWMQARFTAV

SEQ ID NO: 493 - DNA, 693 bp, Artificial Sequence
  Engineered Variants of Esterase  from  Xanthomonas campestris
atgccgagccccgtgactggtcgaactattgagaacgacgtgattgaacgtgaaaccggtccaaacccccaatgggccgtgatttggctgcatggcttgggtgctgatggttctgactttgcaccgatggttccggaactggtcagtccacagtggccagcgttacgcttcgtgtttcctcacgcgccgattcgtccgatcacgatctggaatggcatgcgcatgcgtggttggtacgacatccaggggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggctcgcttcaccgcggtt

SEQ ID NO: 494 - protein, 231 aa, Artificial Sequence
  Engineered Variants of Esterase  from  Xanthomonas campestris
MPSPVTGRTIENDVIERETGPNPQWAVIWLHGLGADGSDFAPMVPELVSPQWPALRFVFPHAPIRPITIWNGMRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFTLEWHSYPMGHQVCVEEIDALRDWMQARFTAV

SEQ ID NO: 495 - DNA, 693 bp, Artificial Sequence
  Engineered Variants of Esterase  from  Xanthomonas campestris
atgccgagccccgtgactggtcgatgcattatcttagacgtgattgaacgtgaaaccggtccaaacccccaatgggccgtgatttggctgcatggcttgggtgctgatggttctgactttgcaccgatggttccggaactggtccgtccacaatggccatctttacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcgcgcttgaatggcatagctacccgatgggccatcaagtgtgctgggaggaaatcgatgcccttcgtgattggatgcaggcccgcttcaccgcggtt

SEQ ID NO: 496 - protein, 231 aa, Artificial Sequence
  Engineered Variants of Esterase  from  Xanthomonas campestris
MPSPVTGRCIILDVIERETGPNPQWAVIWLHGLGADGSDFAPMVPELVRPQWPSLRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFALEWHSYPMGHQVCWEEIDALRDWMQARFTAV

SEQ ID NO: 497 - DNA, 693 bp, Artificial Sequence
  Engineered Variants of Esterase  from  Xanthomonas campestris
atgccgagccccgtgactggtcgatgtattatgttagatgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatcaacaatggcgttcgcatgcgtggttggtacgacatcgtggggatggacttcgcgcaacgttcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcaccgcggtt

SEQ ID NO: 498 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITINNGVRMRGWYDIVGMDFAQRSDKVGIAESVAQVEALIANEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFTAV

SEQ ID NO: 499 - DNA, 693 bp, Artificial Sequence
  Engineered Variants of Esterase  from  Xanthomonas campestris
atgccgagccccgtgactggtcgatgtattatgttagatgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatcaacaatggcgttcgcatgcgtggttggtacgacatcgtggggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggagcgcttcaccgcggtt

SEQ ID NO: 500 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITINNGVRMRGWYDIVGMDFAQRADKVGIAESVAQVEALIANEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQERFTAV

SEQ ID NO: 501 - DNA, 693 bp, Artificial Sequence
  Engineered Variants of Esterase  from  Xanthomonas campestris
atgccgagccccgtgactggtcgatgcattatcttagacgtgattgaacgtgaaaccggtccaaacccccaatgggccgtgatttggctgcatggcttgggtgctgatggttctgactttgcaccgatggttccggaactggtccgtccacaatggccaccgttacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcgcgcttgaatggcatagctacccgatgggccatcaagtgtgctgggaggaaatcgatgcccttcgtgattggatgcaggcccgcttcaccgcggtt

SEQ ID NO: 502 - protein, 231 aa, Artificial Sequence
  Engineered Variants of Esterase  from  Xanthomonas campestris
MPSPVTGRCIILDVIERETGPNPQWAVIWLHGLGADGSDFAPMVPELVRPQWPPLRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFALEWHSYPMGHQVCWEEIDALRDWMQARFTAV

SEQ ID NO: 503 - DNA, 693 bp, Artificial Sequence
  Engineered Variants of Esterase  from  Xanthomonas campestris
atgccgagccccgtgactggtcgacgcattatgctggacgtgattgaacgtgaaaccggtccaaacccccaatgggccgtgatttggctgcatggcttgggtgctgatggttctgactttgcaccgatggttccggaactggtccgtccacagtggccatcgttacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggctcgcttcaccgcggtt

SEQ ID NO: 504 - protein, 231 aa, Artificial Sequence
  Engineered Variants of Esterase  from  Xanthomonas campestris
MPSPVTGRRIMLDVIERETGPNPQWAVIWLHGLGADGSDFAPMVPELVRPQWPSLRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFTLEWHSYPMGHQVCVEEIDALRDWMQARFTAV

SEQ ID NO: 505 - DNA, 693 bp, Artificial Sequence
  Engineered Variants of Esterase  from  Xanthomonas campestris
atgccgagccctgtgacgggtcgctgcattatgttagacgtgattgaacgtgaaaccggtccaaacccccaatgggccgtgatttggctgcatggcttgggtgctgacggttatgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgcaggagaacaaagtgcacaggcattgcaagcattaggtttcgcgcttgaatggcatagctacccgatgggccatcaagtgtgctgggaggaaatcgatgcccttcgtgattggatgcaggcccgcttcacggcggtt

SEQ ID NO: 506 - protein, 231 aa, Artificial Sequence
  Engineered Variants of Esterase  from  Xanthomonas campestris
MPSPVTGRCIMLDVIERETGPNPQWAVIWLHGLGADGYDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFALEWHSYPMGHQVCWEEIDALRDWMQARFTAV

SEQ ID NO: 507 - DNA, 693 bp, Artificial Sequence
  Engineered Variants of Esterase  from  Xanthomonas campestris
atgccaagtcctgttactggtcgctggatgctgctggatgtgattgaacgtgaaaccggtccaaaccctacctgggccgtgatttggctgcatggcttgggtgctgatggttctgactttgcaccgatggttccggaactggtccgtccacaatggccagcattacgcttcgtgtttcctcacgcgccgattcgtccgatcacgatcaacaatggcgttcgcatgcgtggttggtacgacatcgtggggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcaccgcggtt

SEQ ID NO: 508 - protein, 231 aa, Artificial Sequence
  Engineered Variants of Esterase  from  Xanthomonas campestris
MPSPVTGRWMLLDVIERETGPNPTWAVIWLHGLGADGSDFAPMVPELVRPQWPALRFVFPHAPIRPITINNGVRMRGWYDIVGMDFAQRADKVGIAESVAQVEALIANEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFTAV

SEQ ID NO: 509 - DNA, 693 bp, Artificial Sequence
  Engineered Variants of Esterase  from  Xanthomonas campestris
atgccgagccccgtgactggtcgctgtattatgttagatgtgattgaacgtgaaaccgggccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcatggcggtt

SEQ ID NO: 510 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFMAV

SEQ ID NO: 511 - DNA, 693 bp, Artificial Sequence
  Engineered Variants of Esterase  from  Xanthomonas campestris
atgccgagccccgtgactggtcgatgcattatcttagacgtgattgaacgtgaaaccggtccaaacccccaatgggccgtgatttggctgcatggcttgggtgctattggttctgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcgcgcttgaatggcatagctacccgatgggccatcaagtgtgctgggaggaaatcgatgcccttcgtgattggatgcaggcccgcttcaccgcggtt

SEQ ID NO: 512 - protein, 231 aa, Artificial Sequence
  Engineered Variants of Esterase  from  Xanthomonas campestris
MPSPVTGRCIILDVIERETGPNPQWAVIWLHGLGAIGSDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFALEWHSYPMGHQVCWEEIDALRDWMQARFTAV

SEQ ID NO: 513 - DNA, 693 bp, Artificial Sequence
  Engineered Variants of Esterase  from  Xanthomonas campestris
atgccgagccccgtgactggtggctgtattacgttagaagtgattgaacgtgaaaccgggccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgatttttaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcatggcggtt

SEQ ID NO: 514 - protein, 231 aa, Artificial Sequence
  Engineered Variants of Esterase  from  Xanthomonas campestris
MPSPVTGGCITLEVIERETGPNPQWAVIWLHGLGADGSDFAPMVPELVRPQWPALRFVFPHAPIRPITIWNGVRMRGWYDIQGMDFAQRADKVGIAESVAQVEALIFNEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFMAV

SEQ ID NO: 515 - DNA, 693 bp, Artificial Sequence
  Engineered Variants of Esterase  from  Xanthomonas campestris
atgccgagccccgtgactggtcgatgcattatcttagacgtgattgaacgtgaaaccggtccaaacccccaatgggccgtgatttggctgcatggcttgggtgctgatggttctgactttgcaccgatggttccggaactggtccgtccacaatggccagatttacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcgcgcttgaatggcatagctacccgatgggccatcaagtgtgctgggaggaaatcgatgcccttcgtgattggatgcaggcccgcttcaccgcggtt

SEQ ID NO: 516 - protein, 231 aa, Artificial Sequence
  Engineered Variants of Esterase  from  Xanthomonas campestris
MPSPVTGRCIILDVIERETGPNPQWAVIWLHGLGADGSDFAPMVPELVRPQWPDLRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFALEWHSYPMGHQVCWEEIDALRDWMQARFTAV

SEQ ID NO: 517 - DNA, 693 bp, Artificial Sequence
  Engineered Variants of Esterase  from  Xanthomonas campestris
atgccgagccccgtgactggtgcgtgtattatgttagatgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatcaacaatggcgttcgcatgcgtggttggtacgacatcgtggggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcaccgcggtt

SEQ ID NO: 518 - protein, 231 aa, Artificial Sequence
  Engineered Variants of Esterase  from  Xanthomonas campestris
MPSPVTGACIMLDVIERETGPNPQWAVIWLHGLGADGSDFAPMVPELVRPQWPALRFVFPHAPIRPITINNGVRMRGWYDIVGMDFAQRADKVGIAESVAQVEALIANEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFTAV

SEQ ID NO: 519 - DNA, 693 bp, Artificial Sequence
  Engineered Variants of Esterase  from  Xanthomonas campestris
atgccgagccgtgtgccgggtggctgcattacgttagacgtgattgaacgtgaaaccggtccaaacccccaatgggccgtgatttggctgcatggcttgggtgctgacggttatgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgctttggagaacaaagtgcacaggcattgcaagcattaggtttcgcgcttgaatggcatagctacccgatgggccatcaagtgtgctgggaggaaatcgatgcccttcgtgattggatgcaggcccgcttcatggcggtt

SEQ ID NO: 520 - protein, 231 aa, Artificial Sequence
  Engineered Variants of Esterase  from  Xanthomonas campestris
MPSRVPGGCITLDVIERETGPNPQWAVIWLHGLGADGYDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRFGEQSAQALQALGFALEWHSYPMGHQVCWEEIDALRDWMQARFMAV

SEQ ID NO: 521 - DNA, 693 bp, Artificial Sequence
  Engineered Variants of Esterase  from  Xanthomonas campestris
atgccgagccccgtgactggtcgatgtattatgttagatgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatcaacaatggcgttcgcatgcgtggttggtacgacatcgtggggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtacgaggccggagaacaatcagcacaggcattgcaagcattaggtttcacccttgaatggcatagctacccgatgggccatcaagtgtgcgtagaggaaatcgatgcccttcgtgattggatgcaggcccgcttcaccgcggtt

SEQ ID NO: 522 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITINNGVRMRGWYDIVGMDFAQRADKVGIAESVAQVEALIANEQARGIAPDRILLAGFSQGGAVTLAVGLQRRVPLAGLIAMSTYLPDPAAAASQLQPGALAQPLFMAHGSADPVVPYEAGEQSAQALQALGFTLEWHSYPMGHQVCVEEIDALRDWMQARFTAV

SEQ ID NO: 523 - DNA, 693 bp, Artificial Sequence
  Engineered Variants of Esterase  from  Xanthomonas campestris
atgccgagccccgtgactggtcgacgtattatgttagatgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcgcgcttgaatggcatagctacccgatgggccatcaagtgtgctgggaggaaatcgatgcccttcgtgattggatgcaggcccgcttcaccgcggtt

SEQ ID NO: 524 - protein, 231 aa, Artificial Sequence
  Engineered Variants of Esterase  from  Xanthomonas campestris
MPSPVTGRRIMLDVIERETGPNPQWAVIWLHGLGADGSDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFALEWHSYPMGHQVCWEEIDALRDWMQARFTAV

SEQ ID NO: 525 - DNA, 693 bp, Artificial Sequence
  Engineered Variants of Esterase  from  Xanthomonas campestris
atgccgagccccgtgactggtcgatgtattatgttagaggtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatcaacaatggcgttcgcatgcgtggttggtacgacatcgtggggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctaccagatgggccatcaagtgtgcgtagaggaaatcgatgcccttcgtgattggatgcaggcccgcttcaccgcggtt

SEQ ID NO: 526 - protein, 231 aa, Artificial Sequence
  Engineered Variants of Esterase  from  Xanthomonas campestris
MPSPVTGRCIMLEVIERETGPNPQWAVIWLHGLGADGSDFAPMVPELVRPQWPALRFVFPHAPIRPITINNGVRMRGWYDIVGMDFAQRADKVGIAESVAQVEALIANEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYQMGHQVCVEEIDALRDWMQARFTAV

SEQ ID NO: 527 - DNA, 693 bp, Artificial Sequence
  Engineered Variants of Esterase  from  Xanthomonas campestris
atgccgcgccgtgtgccgggtcgctgcattatcttagacgtgattgaacgtgaaaccggtccaaacccccaatgggccgtgatttggctgcatggcttgggtgctaacggttatgactttgcaccgatggttccggaactggtccgtccacaatggccagcattacgcttcgtgtttcctcacgcgccgattcgcccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgcaggagaacaaagtgcacaggcattgcaagcattaggtttcgcgcttgaatggcatagctacccgatgggccatcaagtgtgctgggaggaaatcgatgcccttcgtgattggatgcaggcccgcttcatggcggtt

SEQ ID NO: 528 - protein, 231 aa, Artificial Sequence
  Engineered Variants of Esterase  from  Xanthomonas campestris
MPRRVPGRCIILDVIERETGPNPQWAVIWLHGLGANGYDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFALEWHSYPMGHQVCWEEIDALRDWMQARFMAV

SEQ ID NO: 529 - DNA, 693 bp, Artificial Sequence
  Engineered Variants of Esterase  from  Xanthomonas campestris
atgccgagccccgtgactggtcgaactattatgctggacgtgattgaacgtgaaaccggtccaaacccccaatgggccgtgatttggctgcatggcttgggtgctgatggttctgactttgcaccgatggttccggaactggtcagtccagactggccatcgttacgcttcgtgtttcctcacgcgccgattcgtccgatcacgatctggaatggcatgcgcatgcgtggttggtacgacatccaagggatggacttcgcgcaacgtgcggataaggtgggtattgcggagagtgttgcacaagttgaagccctgattgctcacgaaatggcacgcgggattgctccagatcgtattctgttggcgggctttagtcagggcggcgcggtaacgttagcagttggtcttcagcgtcgtgttccattagcgggcctgattgcgctgtccacctacttaccagatccagccgctgccgccagtcaactgcaaccgggtgcattagcccagccattgttcatggcacatggatcggcagacctggttgttccgtaccgcgccggagaacaatcagcaatggcattgcaagcattaggtttcacccttgaatggcatagctacccgatgggccatcaagtgtgcgtagaggaaatcgatgcccttcgtgattggatgcaggctcgcttcaccgcggtt

SEQ ID NO: 530 - protein, 231 aa, Artificial Sequence
  Engineered Variants of Esterase  from  Xanthomonas campestris
MPSPVTGRTIMLDVIERETGPNPQWAVIWLHGLGADGSDFAPMVPELVSPDWPSLRFVFPHAPIRPITIWNGMRMRGWYDIQGMDFAQRADKVGIAESVAQVEALIAHEMARGIAPDRILLAGFSQGGAVTLAVGLQRRVPLAGLIALSTYLPDPAAAASQLQPGALAQPLFMAHGSADLVVPYRAGEQSAMALQALGFTLEWHSYPMGHQVCVEEIDALRDWMQARFTAV

SEQ ID NO: 531 - DNA, 693 bp, Artificial Sequence
  Engineered Variants of Esterase  from  Xanthomonas campestris
atgccgagccccgtgactggtcgatgcattatcttagacgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgctttccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcgcgcttgaatggcatagctacccgatgggccatcaagtgtgctgggaggaaatcgatgcccttcgtgattggatgcaggcccgcttcaccgcggtt

SEQ ID NO: 532 - protein, 231 aa, Artificial Sequence
  Engineered Variants of Esterase  from  Xanthomonas campestris
MPSPVTGRCIILDVIERETGPNPQWAVIWLHGLGADGSDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIALSTYLPDPAAAASQLQPGALAQPLFMAHGSADLVVPYRAGEQSAQALQALGFALEWHSYPMGHQVCWEEIDALRDWMQARFTAV

SEQ ID NO: 533 - DNA, 693 bp, Artificial Sequence
  Engineered Variants of Esterase  from  Xanthomonas campestris
atgccgagccccgtgactggtcgatgtattatgttagatgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatcaacaatggcgttcgcatgcgtggttggtacgacatcgtggggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacccagttgttccgtaccgcgccggagaacaatcagcacaggcattgcaagcattaggtttcacccttgaatggcatagctacccgatgggccatcaagtgtgcgtagaggaaatcgatgcccttcgtgattggatgcaggcccgcttcaccgcggtt

SEQ ID NO: 534 - protein, 231 aa, Artificial Sequence
  Engineered Variants of Esterase  from  Xanthomonas campestris
MPSPVTGRCIMLDVIERETGPNPQWAVIWLHGLGADGSDFAPMVPELVRPQWPALRFVFPHAPIRPITINNGVRMRGWYDIVGMDFAQRADKVGIAESVAQVEALIANEQARGIAPDRILLAGFSQGGAVTLAVGLQRRVPLAGLIAMSTYLPDPAAAASQLQPGALAQPLFMAHGSADPVVPYRAGEQSAQALQALGFTLEWHSYPMGHQVCVEEIDALRDWMQARFTAV

SEQ ID NO: 535 - DNA, 693 bp, Artificial Sequence
  Engineered Variants of Esterase  from  Xanthomonas campestris
atgccgagccccgtgactggtcgatgcattatcttagacgtgattgaacgtgaaaccggtccaaacccccaatgggccgtgatttggctgcatggcttgggtgctgatggttctgactttgcaccgatggttccggaactggtccgtccacaatggccagcattacgcttcgtgtttcctcacgcgccgattcgtccgatcacgatctggaatggcgttcgcatgcgtggttggtacgacatccaagggatggacttcgcgcaacgtgcggataaggtgggtattgcggagagtgttgcacaagttgaagccctgattgctaatgaacaggcacgcgggattgctccagatcgtattctgttggcgggctttagtcagggcggcgcggtaacgttagcagttggtcttcagcgtcgtgttccattagcgggcctgattgcgatgtccacctacttaccagatccagccgctgccgccagtcaactgcaaccgggtgcattagcccagccattgttcatggcacatggatcggcagacctggttgttccgtaccgcgccggagaacaatcagcacaggcattgcaagcattaggtttcgcgcttgaatggcatagctacccgatgggccatcaagtgtgctgggaggaaatcgatgcccttcgtgattggatgcaggcccgcttcaccgcggtt

SEQ ID NO: 536 - protein, 231 aa, Artificial Sequence
  Engineered Variants of Esterase  from  Xanthomonas campestris
MPSPVTGRCIILDVIERETGPNPQWAVIWLHGLGADGSDFAPMVPELVRPQWPALRFVFPHAPIRPITIWNGVRMRGWYDIQGMDFAQRADKVGIAESVAQVEALIANEQARGIAPDRILLAGFSQGGAVTLAVGLQRRVPLAGLIAMSTYLPDPAAAASQLQPGALAQPLFMAHGSADLVVPYRAGEQSAQALQALGFALEWHSYPMGHQVCWEEIDALRDWMQARFTAV

The invention claimed is:

1. An engineered carboxyesterase comprising a polypeptide sequence having at least 90%, sequence identity to SEQ ID NO: 2 or a functional fragment thereof, wherein said engineered carboxyesterase comprises the substitution set 9/10/70 in said polypeptide sequence, and wherein the amino acid positions of said polypeptide sequence are numbered with reference to SEQ ID NO: 2, and wherein the engineered carboxyesterase comprises at least one improved property compared to the wild-type *Xanthomonas campestris* carboxyesterase of SEQ ID NO:2.

2. The engineered carboxyesterase of claim 1, wherein said engineered carboxyesterase further comprises one or more amino acid substitutions at positions selected from: X82, and X180.

3. The engineered carboxyesterase of claim 1, wherein said at least one substitution or substitution set in said polypeptide sequence further comprises substitutions at positions selected from: 3/4/6/11/36/38/82/180/200/214/229, 3/6/99, 3/8/11/13/82/107/229, 3/8/11/13/70/107, 3/8/11, 3/8/11/229, 3/8/13/82/107, 3/8/13/82/229, 3/8/82, 3/8/82/229, 3/8/229, 3/11/13/82, 3/11/782/107, 3/11/229, 3/82, 3/11, 3/9/11/82/180, 4/6/8/11/38/82/180/186/200/214/229, 4/6/11/36/82/180/200/214/229, 4/6/11/38/82/180/186/200/214, 4/6/82/229, 4/8/11/13/82/107/229, 4/8/11/36/38/82/180/200/214/229, 4/8/11/36/82/180/186/200/214/229, 4/8/11/82/180/200/214/229, 4/8/36/38/82/180/200/214/229, 4/11/36/38/82/180/200/214/229, 4/11/36/65/82/180/186/200/214, 4/11/36/82/180/200/214, 4/11/36/82/180/200/214/229, 4/11/82/180/200/214, 6/8/38/82/180/200/214, 6/11/36/82/180/200/214/229, 6/38/82/180/186/200/214/229, 6/82/180/186/200/214/229, 8, 8/11/13, 8/11/13/82, 8/11/13/82/107/229, 8/11/36/38/82/180/200/214, 8/11/38/82/180/200/214/229, 8/11/43/82/180/200/214, 8/11, 8/11/82/107/229, 8/11/229, 8/82/229, 11/12/49/51/73/82/180/200/225, 11/12/49/73/82/180, 11/12/51/54/73/82/108/148/180/225, 11/12/51/54/73/82/110/180, 11/12/51/54/73/82/148/180/225, 11/12/51/73/82/148/180, 11/12/51/73/82/148/180/200/225, 11/12/51/73/110/148/180, 11/17/49/82/180/200, 11/17/49/82/180/219, 11/17/51/54/82/148/180/200, 11/17/51/54/82/180, 11/17/73/82/87/180/219, 11/17/82/148/180/219, 11/35/82/180/200/214, 11/36/38/65/82/180/200/214/229, 11/36/38/82/180/200/214, 11/36/38/82/180/200/214/229, 11/36/82/180/196/214, 11/36/82/180/200/214, 11/36/82/180/200/214/229, 11/38/82/180/186/200/214, 11/40/78/82/180/200/214, 11/49/51/54/82/87/108/110/148/180/219, 11/49/51/54/82/87/108/180, 11/49/51/54/82/110/148/180, 11/49/51/82/108/10/148/180, 11/49/54/82/87/148/180, 11/49/82/87/108/110/180/200, 11/49/82/87/180, 11/49/82/110/148/180/225, 11/51/54/73/82/108/110/180, 11/51/54/73/82/108/180/200/225, 11/51/54/73/82/110/148/180, 11/51/54/82/148/180, 11/51/82/110/180/192/219, 11/54/82/87/108/180, 11/54/82/87/180/192, 11/54/82/148/180/200, 11/54/82/180/200/214, 11/70, 11/71/82/180/200/214, 9/10/11/73/82/87/110/180, 11/73/82/108/148/180, 11/73/82/148/180, 11/73/82/148/180/192/200, 11/73/82/180/200/214, 11/82, 11/82/87/110/180/219, 11/82/100/180/200/214, 11/82/107, 11/82/108/180/200/214, 11/82/148/180, 11/82/148/180/200/214, 11/82/180, 11/82/180/200/214, 11/87/180/200/214, 11/107, 12/49/51/54/82/108/148/180/225, 12/51/54/180/225, 12/51/73/82/148/180/200, 12/82/148/180/225, 12/82/180/200/214, 13, 13/82, 13/229, 13/207, 17, 17/49/51/54/73/82/108/110/148/180/192/200/219, 17/49/51/54/82/87/180/219, 17/49/82/148/180, 17/51/54/82/87/108/110/180/200, 17/51/73/82/87/108/110/148/180/219, 17/54/73/82/87/108/110/148/180/200, 17/54/73/82/108/110/148/180, 17/54/82/87/108/110/180, 17/73/82/87/180/219, 17/73/82/108/110/148/180/200, 17/82/87/148/180, 17/82/87/148/180/192/219, 17/82/108/148/180, 17/82/110/148/180, 17/82/110/148/180/200, 17/82/180/200/214, 17/104/160/165, 17/139/160/165, 26, 29, 36/82/180/200/214, 37, 38/82/180/200/214, 39, 39/186, 41, 45, 49/51/54/73/82/108/110/148/180/192, 49/51/54/73/82/148/180, 49/51/54/82/108/110/148/180/225, 49/51/54/70/82/110/148/180, 49/51/54/82/110/180, 49/51/54/82/148/180, 49/51/54/82/148/180/192, 49/51/82/108/148/180/219, 49/51/82/110/148/180, 49/51/82/180/225, 49/54/73/82/87/110/180, 49/54/82/87/110/180, 49/54/82/108/148/180/225, 49/73/82/87/108/148/180, 49/73/82/108/110/148/180/225, 49/82/87/148/180, 49/82/110/180/219, 51/54/73/82/108/180, 51/54/73/82/110/148/180, 51/54/73/82/110/180, 51/54/73/82/180/219, 51/54/73/82/180/225, 51/54/82/87/180, 51/54/82/148/180, 51/54/82/180, 51/54/82/180/200, 51/82/108/180, 51/82/110/180/200, 51/70/82/180/219, 54/73/82/108/148/180/192, 54/70/82/87/108/180/200, 54/70/82/180, 62, 73/82/87/108/110/180, 73/82/87/180/192/219, 73/82/87/180/200, 73/82/108/110/148/180, 73/82/108/110/180/200/219, 73/82/108/148/180, 73/82/108/148/180/192, 73/82/108/148/180/192/219, 73/82/108/180, 73/82/148/180, 73/82/148/180/200, 73/82/180/192, 73/82/180/192/219, 82, 82/87/108/110/148/180/192/219, 82/87/108/110/180, 82/87/108/110/180/192, 82/87/180, 82/107, 82/107/229, 82/108/110/180/219, 82/108/180, 82/110/148/180, 82/110/180/219, 82/148/180, 82/148/180/200, 82/148/180/200/219, 82/180, 82/180/192/219, 82/180/200/214, 82/229, 92, 99, 99/229, 107/229, 156, 165, 229, 8890, 96, 107, 110, 111, 112, 133, 178, 185, 186, 196, 211, 226, 11/24, 11/24/219, and 11/36/206/208, wherein the amino acid positions of said polypeptide sequence are numbered with reference to SEQ ID NO: 2.

4. The engineered carboxyesterase of claim 1, wherein the engineered carboxyesterase has at least 95% to SEQ ID NO: 2, and wherein said at least one substitution or substitution set in said polypeptide sequence comprises substitutions at positions selected from: 3/4/6/9/10/11/36/38/70/82/180/200/214/229, 3/6/9/10/70/99, 3/8/9/10/11/13/70/82/107/229, 3/8/9/10/11/13/70/107, 3/8/9/10/11/70, 3/8/9/10/11/70/229, 3/8/9/10/13/70/82/107, 3/8/9/10/13/70/82/229, 3/8/9/10/70/82, 3/8/9/10/70/82/229, 3/8/9/10/70/229, 3/9/10/11/13/82, 3/9/10/11/70/82/107, 3/9/10/11/70/229, 3/9/10/70/82, 3/9/11, 3/9/11/70/82/180, 4/6/8/9/10/11/38/70/82/180/186/200/214/229, 4/6/9/10/11/36/70/82/180/200/214/229, 4/6/9/10/11/38/70/82/180/186/200/214, 4/6/9/10/70/82/229, 4/8/9/10/11/13/70/82/107/229, 4/8/9/10/11/36/38/70/82/180/200/214/229, 4/8/9/10/11/36/70/82/180/186/200/214/229, 4/8/9/10/11/70/82/180/200/214/229, 4/8/9/10/36/38/70/82/180/200/214/229, 4/9/10/11/36/38/70/82/180/200/214/229, 4/9/10/11/36/65/70/82/180/186/200/214, 4/9/10/11/36/70/82/180/200/214, 4/9/10/11/36/70/82/180/200/214/229, 4/9/10/11/70/82/180/200/214, 6/8/9/10/38/70/82/180/200/214, 6/9/10/11/36/70/82/180/200/214/229, 6/9/10/38/70/82/180/186/200/214/229, 6/9/10/70/82/180/186/200/214/229, 8/9/10, 8/9/10/11/13/70, 8/9/10/11/13/70/82, 8/9/10/11/13/70/82/107/229, 8/9/10/11/36/38/70/82/180/200/214, 8/9/10/11/38/70/82/180/200/214/229, 8/9/10/11/43/70/82/180/200/214, 8/9/10/11/70, 8/9/10/11/70/82/107/229, 8/9/10/11/70/229, 8/9/10/70, 8/9/10/70/82/229, 9/10, 9/10/11/12/49/51/70/73/82/180/200/225, 9/10/11/12/49/70/73/82/180, 9/10/11/12/51/54/70/73/82/108/148/180/225, 9/10/11/12/51/54/70/73/82/110/180, 9/10/11/12/51/54/70/73/82/148/180/225, 9/10/11/12/51/70/73/82/148/180, 9/10/11/12/51/70/73/82/148/180/200/225, 9/10/11/12/51/70/73/110/148/180, 9/10/11/17/49/70/82/180/200, 9/10/11/17/49/70/82/180/219, 9/10/11/17/51/54/70/82/148/180/200, 9/10/11/17/51/54/70/82/180, 9/10/11/17/70/73/82/87/180/219, 9/10/11/17/70/82/148/180/219, 9/10/11/35/70/82/180/200/214, 9/10/11/36/38/65/70/82/180/200/214/229, 9/10/11/36/38/70/82/180/200/214, 9/10/11/36/38/70/82/180/200/214/229, 9/10/11/36/70/82/180/196/214, 9/10/11/36/70/82/180/200/214, 9/10/11/36/70/82/180/200/214/229, 9/10/11/38/70/82/180/186/200/214, 9/10/11/40/70/82/180/200/214, 9/10/11/49/51/54/70/82/87/108/110/148/180/219, 9/10/11/49/51/54/70/82/87/108/180, 9/10/11/49/51/54/70/82/110/148/180, 9/10/11/49/51/70/82/108/110/148/180, 9/10/11/49/54/70/82/87/148/180, 9/10/11/49/70/82/87/108/110/180/200, 9/10/11/49/70/82/87/180, 9/10/11/49/70/82/110/148/180/225, 9/10/11/51/54/70/73/82/108/110/180, 9/10/11/51/54/70/73/82/108/180/200/225, 9/10/11/51/54/70/73/82/110/148/180, 9/10/11/51/54/70/82/148/180, 9/10/11/51/70/82/110/180/192/219, 9/10/11/54/70/82/87/108/180, 9/10/11/54/70/82/87/180/192, 9/10/11/54/70/82/148/180/200, 9/10/11/54/70/82/180/200/214, 9/10/11/70, 9/10/11/70/71/82/180/200/214, 9/10/11/70/73/82/87/110/180, 9/10/11/70/73/82/108/148/180, 9/10/11/70/73/82/148/180, 9/10/11/70/73/82/148/180/192/200, 9/10/11/70/73/82/180/200/214, 9/10/11/70/82, 9/10/11/70/82/87/110/180/219, 9/10/11/70/82/100/180/200/214, 9/10/11/70/82/107, 9/10/11/70/82/108/180/200/214, 9/10/11/70/82/148/180, 9/10/11/70/82/148/180/200/214, 9/10/11/70/82/180, 9/10/11/70/82/180/200/214, 9/10/11/70/87/180/200/214, 9/10/11/70/107, 9/10/12/49/51/54/70/82/108/148/180/225, 9/10/12/51/54/70/180/225, 9/10/12/51/70/73/82/148/180/200, 9/10/12/70/82/148/180/225, 9/10/12/70/82/180/200/214, 9/10/13/70, 9/10/13/70/82, 9/10/13/70/229, 9/10/13/207, 9/10/17, 9/10/17/49/51/54/70/73/82/108/110/148/180/192/200/219, 9/10/17/49/51/54/70/82/87/180/219, 9/10/17/49/70/82/148/180, 9/10/17/51/54/70/82/87/108/110/180/200, 9/10/17/51/70/73/82/87/108/110/148/180/219, 9/10/17/54/70/73/82/87/108/110/148/180/200, 9/10/17/54/70/73/82/108/110/148/180, 9/10/17/54/70/82/87/108/110/180, 9/10/17/70/73/82/87/180/219, 9/10/17/70/73/82/108/110/148/180/200, 9/10/17/70/82/87/148/180, 9/10/17/70/82/87/148/180/192/219, 9/10/17/70/82/108/148/180, 9/10/17/70/82/110/148/180, 9/10/17/70/82/110/148/180/200, 9/10/17/70/82/180/200/214, 9/10/17/70/104/160/165, 9/10/17/70/139/160/165, 9/10/26, 9/10/29/70, 9/10/36/70/82/180/200/214, 9/10/37, 9/10/38/70/82/180/200/214, 9/10/39, 9/10/39/186, 9/10/41, 9/10/45/70, 9/10/49/51/54/70/73/82/108/110/148/180/192, 9/10/49/51/54/70/73/82/148/180, 9/10/49/51/54/70/82/108/110/148/180/225, 9/10/49/51/54/70/82/110/148/180, 9/10/49/51/54/70/82/110/180, 9/10/49/51/54/70/82/148/180, 9/10/49/51/54/70/82/148/180/192, 9/10/49/51/70/82/108/148/180/219, 9/10/49/51/70/82/110/148/180, 9/10/49/51/70/82/180/225, 9/10/49/54/70/73/82/87/110/180, 9/10/49/54/70/82/87/110/180, 9/10/49/54/70/82/108/148/180/225, 9/10/49/70/73/82/87/108/148/180, 9/10/49/70/73/82/108/110/148/180/225, 9/10/49/70/82/87/148/180, 9/10/49/70/82/110/180/219, 9/10/51/54/70/73/82/108/180, 9/10/51/54/70/73/82/110/148/180, 9/10/51/54/70/73/82/110/180, 9/10/51/54/70/73/82/180/219, 9/10/51/54/70/73/82/180/225, 9/10/51/54/70/82/87/180, 9/10/51/54/70/82/148/180, 9/10/51/54/70/82/180, 9/10/51/54/70/82/180/200, 9/10/51/70/82/108/180, 9/10/51/70/82/110/180/200, 9/10/51/70/82/180/219, 9/10/54/70/73/82/108/148/180/192, 9/10/54/70/82/87/108/180/200, 9/10/54/70/82/180, 9/10/62, 9/10/70, 9/10/70/73/82/87/108/110/180, 9/10/70/73/82/87/180/192/219, 9/10/70/73/82/87/180/200, 9/10/70/73/82/108/110/148/180, 9/10/70/73/82/108/110/180/200/219, 9/10/70/73/82/108/148/180, 9/10/70/73/82/108/148/180/192, 9/10/70/73/82/108/148/180/192/219, 9/10/70/73/82/108/180, 9/10/70/73/82/148/180, 9/10/70/73/82/148/180/200, 9/10/70/73/82/180/192, 9/10/70/73/82/180/192/219, 9/10/70/82, 9/10/70/82/87/108/110/148/180/192/219, 9/10/70/82/87/108/110/180, 9/10/70/82/87/108/110/180/192, 9/10/70/82/87/180, 9/10/70/82/107, 9/10/70/82/107/229, 9/10/70/82/108/110/180/219, 9/10/70/82/108/180, 9/10/70/82/110/148/180, 9/10/70/82/110/180/219, 9/10/70/82/148/180, 9/10/70/82/148/180/200, 9/10/70/82/148/180/200/219, 9/10/70/82/180, 9/10/70/82/180/192/219, 9/10/70/82/180/200/214, 9/10/70/82/229, 9/10/70/92, 9/10/70/99, 9/10/70/99/229, 9/10/70/107/229, 9/10/70/156, 9/10/70/165, 9/10/70/229, 9/10/88, 9/10/90, 9/10/96, 9/10/107, 9/10/110, 9/10/111, 9/10/112, 9/10/133, 9/10/178, 9/10/185, 9/10/186, 9/10/196, 9/10/211, 9/10/226, 11/24, 11/24/219, and 11/36/206/208, wherein the amino acid positions of said polypeptide sequence are numbered with reference to SEQ ID NO: 82.

5. The engineered carboxyesterase of claim 1, wherein said at least one substitution or substitution set in said polypeptide sequence comprises further substitutions at positions selected from: 3/4/6/9/10/11/36/38/70/82/180/200/214/229, 3/6/9/10/70/99, 3/8/9/10/11/13/70/82/107/229, 3/8/9/10/11/13/70/107, 3/8/9/10/11/70, 3/8/9/10/11/70/229, 3/8/9/10/13/70/82/107, 3/8/9/10/13/70/82/229, 3/8/9/10/70/82, 3/8/9/10/70/82/229, 3/8/9/10/70/229, 3/9/10/11/13/82, 3/9/10/11/70/82/107, 3/9/10/11/70/229, 3/9/10/70/82, 3/9/11, 3/9/11/70/82/180, 4/6/8/9/10/11/38/70/82/180/186/200/214/229, 4/6/9/10/11/36/70/82/180/200/214/229, 4/6/9/10/11/38/70/82/180/186/200/214, 4/6/9/10/70/82/229, 4/8/9/10/11/13/70/82/107/229, 4/8/9/10/11/36/38/70/82/180/200/214/229, 4/8/9/10/11/36/70/82/180/186/200/214/229, 4/8/9/10/11/70/82/180/200/214/229, 4/8/9/10/36/38/70/82/180/200/214/229, 4/9/10/11/36/38/70/82/180/200/214/229, 4/9/10/11/36/65/70/82/180/186/200/214, 4/9/10/11/36/70/82/180/200/214, 4/9/10/11/36/70/82/180/200/214/229, 4/9/10/11/70/82/180/200/214, 6/8/9/10/38/70/82/180/200/214, 6/9/10/11/36/70/82/180/200/214/229, 6/9/10/38/70/82/180/186/200/214/229, 6/9/10/70/82/180/186/200/214/229, 8/9/10, 8/9/10/11/13/70, 8/9/10/11/13/70/82, 8/9/10/11/13/70/82/107/229, 8/9/10/11/36/38/70/82/180/200/214, 8/9/10/11/38/70/82/180/200/214/229, 8/9/10/11/43/70/82/180/200/214, 8/9/10/11/70, 8/9/10/11/70/82/107/229, 8/9/10/11/70/229, 8/9/10/70, 8/9/10/70/82/229, 9/10, 9/10/11/12/49/51/70/73/82/180/200/225, 9/10/11/12/49/70/73/82/180, 9/10/11/12/51/54/70/73/82/108/148/180/225, 9/10/11/12/51/54/70/73/

82/110/180, 9/10/11/12/51/54/70/73/82/148/180/225, 9/10/11/12/51/70/73/82/148/180, 9/10/11/12/51/70/73/82/148/180/200/225, 9/10/11/12/51/70/73/110/148/180, 9/10/11/17/49/70/82/180/200, 9/10/11/17/49/70/82/180/219, 9/10/11/17/51/54/70/82/148/180/200, 9/10/11/17/51/54/70/82/180, 9/10/11/17/70/73/82/87/180/219, 9/10/11/17/70/82/148/180/219, 9/10/11/35/70/82/180/200/214, 9/10/11/36/38/65/70/82/180/200/214/229, 9/10/11/36/38/70/82/180/200/214, 9/10/11/36/38/70/82/180/200/214/229, 9/10/11/36/70/82/180/196/214, 9/10/11/36/70/82/180/200/214, 9/10/11/36/70/82/180/200/214/229, 9/10/11/38/70/82/180/186/200/214, 9/10/11/40/70/82/180/200/214, 9/10/11/49/51/54/70/82/87/108/110/148/180/219, 9/10/11/49/51/54/70/82/87/108/180, 9/10/11/49/51/54/70/82/110/148/180, 9/10/11/49/51/70/82/108/110/148/180, 9/10/11/49/54/70/82/87/148/180, 9/10/11/49/70/82/87/108/110/180/200, 9/10/11/49/70/82/87/180, 9/10/11/49/70/82/110/148/180/225, 9/10/11/51/54/70/73/82/108/110/180, 9/10/11/51/54/70/73/82/108/180/200/225, 9/10/11/51/54/70/73/82/110/148/180, 9/10/11/51/54/70/82/148/180, 9/10/11/51/70/82/110/180/192/219, 9/10/11/54/70/82/87/108/180, 9/10/11/54/70/82/87/180/192, 9/10/11/54/70/82/148/180/200, 9/10/11/54/70/82/180/200/214, 9/10/11/70, 9/10/11/70/71/82/180/200/214, 9/10/11/70/73/82/87/110/180, 9/10/11/70/73/82/108/148/180, 9/10/11/70/73/82/148/180, 9/10/11/70/73/82/148/180/192/200, 9/10/11/70/73/82/180/200/214, 9/10/11/70/82, 9/10/11/70/82/87/110/180/219, 9/10/11/70/82/100/180/200/214, 9/10/11/70/82/107, 9/10/11/70/82/108/180/200/214, 9/10/11/70/82/148/180, 9/10/11/70/82/148/180/200/214, 9/10/11/70/82/180, 9/10/11/70/82/180/200/214, 9/10/11/70/87/180/200/214, 9/10/11/70/107, 9/10/12/49/51/54/70/82/108/148/180/225, 9/10/12/51/54/70/180/225, 9/10/12/51/70/73/82/148/180/200, 9/10/12/70/82/148/180/225, 9/10/12/70/82/180/200/214, 9/10/13/70, 9/10/13/70/82, 9/10/13/70/229, 9/10/13/207, 9/10/17, 9/10/17/49/51/54/70/73/82/108/110/148/180/192/200/219, 9/10/17/49/51/54/70/82/87/180/219, 9/10/17/49/70/82/148/180, 9/10/17/51/54/70/82/87/108/110/180/200, 9/10/17/51/70/73/82/87/108/110/148/180/219, 9/10/17/54/70/73/82/87/108/110/148/180/200, 9/10/17/54/70/73/82/108/110/148/180, 9/10/17/54/70/82/87/108/110/180, 9/10/17/70/73/82/87/180/219, 9/10/17/70/73/82/108/110/148/180/200, 9/10/17/70/82/87/148/180, 9/10/17/70/82/87/148/180/192/219, 9/10/17/70/82/108/148/180, 9/10/17/70/82/110/148/180, 9/10/17/70/82/110/148/180/200, 9/10/17/70/82/180/200/214, 9/10/17/70/104/160/165, 9/10/17/70/139/160/165, 9/10/26, 9/10/29/70, 9/10/36/70/82/180/200/214, 9/10/37, 9/10/38/70/82/180/200/214, 9/10/39, 9/10/39/186, 9/10/41, 9/10/45/70, 9/10/49/51/54/70/73/82/108/110/148/180/192, 9/10/49/51/54/70/73/82/148/180, 9/10/49/51/54/70/82/108/110/148/180/225, 9/10/49/51/54/70/82/110/148/180, 9/10/49/51/54/70/82/110/180, 9/10/49/51/54/70/82/148/180, 9/10/49/51/54/70/82/148/180/192, 9/10/49/51/70/82/108/148/180/219, 9/10/49/51/70/82/110/148/180, 9/10/49/51/70/82/180/225, 9/10/49/54/70/73/82/87/110/180, 9/10/49/54/70/82/87/110/180, 9/10/49/54/70/82/108/148/180/225, 9/10/49/70/73/82/87/108/148/180, 9/10/49/70/73/82/108/110/148/180/225, 9/10/49/70/82/87/148/180, 9/10/49/70/82/110/180/219, 9/10/51/54/70/73/82/108/180, 9/10/51/54/70/73/82/110/148/180, 9/10/51/54/70/73/82/110/180, 9/10/51/54/70/73/82/180/219, 9/10/51/54/70/73/82/180/225, 9/10/51/54/70/82/87/180, 9/10/51/54/70/82/148/180, 9/10/51/54/70/82/180, 9/10/51/54/70/82/180/200, 9/10/51/70/82/108/180, 9/10/51/70/82/110/180/200, 9/10/51/70/82/180/219, 9/10/54/70/73/82/108/148/180/192, 9/10/54/70/82/87/108/180/200, 9/10/54/70/82/180, 9/10/62, 9/10/70, 9/10/70/73/82/87/108/110/180, 9/10/70/73/82/87/180/192/219, 9/10/70/73/82/87/180/200, 9/10/70/73/82/108/110/148/180, 9/10/70/73/82/108/110/180/200/219, 9/10/70/73/82/108/148/180, 9/10/70/73/82/108/148/180/192, 9/10/70/73/82/108/148/180/192/219, 9/10/70/73/82/108/180, 9/10/70/73/82/148/180, 9/10/70/73/82/148/180/200, 9/10/70/73/82/180/192, 9/10/70/73/82/180/192/219, 9/10/70/82, 9/10/70/82/87/108/110/148/180/192/219, 9/10/70/82/87/108/110/180, 9/10/70/82/87/108/110/180/192, 9/10/70/82/87/180, 9/10/70/82/107, 9/10/70/82/107/229, 9/10/70/82/108/110/180/219, 9/10/70/82/108/180, 9/10/70/82/110/148/180, 9/10/70/82/110/180/219, 9/10/70/82/148/180, 9/10/70/82/148/180/200, 9/10/70/82/148/180/200/219, 9/10/70/82/180, 9/10/70/82/180/192/219, 9/10/70/82/180/200/214, 9/10/70/82/229, 9/10/70/92, 9/10/70/99, 9/10/70/99/229, 9/10/70/107/229, 9/10/70/156, 9/10/70/165, 9/10/70/229, 9/10/88, 9/10/90, 9/10/96, 9/10/107, 9/10/110, 9/10/111, 9/10/112, 9/10/133, 9/10/178, 9/10/185, 9/10/186, 9/10/196, 9/10/211, 9/10/226, 11/24, 11/24/219, and 11/36/206/208, wherein the amino acid positions of said polypeptide sequence are numbered with reference to SEQ ID NO: 268.

6. The engineered carboxyesterase of claim 1, wherein said at least one substitution or substitution set in said polypeptide sequence further comprises substitutions at positions selected from: 3/4/6/9/10/11/36/38/70/82/180/200/214/229, 3/6/9/10/70/99, 3/8/9/10/11/13/70/82/107/229, 3/8/9/10/11/13/70/107, 3/8/9/10/11/70, 3/8/9/10/11/70/229, 3/8/9/10/13/70/82/107, 3/8/9/10/13/70/82/229, 3/8/9/10/70/82, 3/8/9/10/70/82/229, 3/8/9/10/70/229, 3/9/10/11/13/82, 3/9/10/11/70/82/107, 3/9/10/11/70/229, 3/9/10/70/82, 3/9/11, 3/9/11/70/82/180, 4/6/8/9/10/11/38/70/82/180/186/200/214/229, 4/6/9/10/11/36/70/82/180/200/214/229, 4/6/9/10/11/38/70/82/180/186/200/214, 4/6/9/10/70/82/229, 4/8/9/10/11/13/70/82/107/229, 4/8/9/10/11/36/38/70/82/180/200/214/229, 4/8/9/10/11/36/70/82/180/186/200/214/229, 4/8/9/10/11/70/82/180/200/214/229, 4/8/9/10/36/38/70/82/180/200/214/229, 4/9/10/11/36/38/70/82/180/200/214/229, 4/9/10/11/36/65/70/82/180/186/200/214, 4/9/10/11/36/70/82/180/200/214, 4/9/10/11/36/70/82/180/200/214/229, 4/9/10/11/70/82/180/200/214, 6/8/9/10/38/70/82/180/200/214, 6/9/10/11/36/70/82/180/200/214/229, 6/9/10/38/70/82/180/186/200/214/229, 6/9/10/70/82/180/186/200/214/229, 8/9/10, 8/9/10/11/13/70, 8/9/10/11/13/70/82, 8/9/10/11/13/70/82/107/229, 8/9/10/11/36/38/70/82/180/200/214, 8/9/10/11/38/70/82/180/200/214/229, 8/9/10/11/43/70/82/180/200/214, 8/9/10/11/70, 8/9/10/11/70/82/107/229, 8/9/10/11/70/229, 8/9/10/70, 8/9/10/70/82/229, 9/10, 9/10/11/12/49/51/70/73/82/180/200/225, 9/10/11/12/49/70/73/82/180, 9/10/11/12/51/54/70/73/82/108/148/180/225, 9/10/11/12/51/54/70/73/82/110/180, 9/10/11/12/51/54/70/73/82/148/180/225, 9/10/11/12/51/70/73/82/148/180, 9/10/11/12/51/70/73/82/148/180/200/225, 9/10/11/12/51/70/73/110/148/180, 9/10/11/17/49/70/82/180/200, 9/10/11/17/49/70/82/180/219, 9/10/11/17/51/54/70/82/148/180/200, 9/10/11/17/51/54/70/82/180, 9/10/11/17/70/73/82/87/180/219, 9/10/11/17/70/82/148/180/219, 9/10/11/35/70/82/180/200/214, 9/10/11/36/38/65/70/82/180/200/214/229, 9/10/11/36/38/70/82/180/200/214, 9/10/11/36/38/70/82/180/200/214/229, 9/10/11/36/70/82/180/196/214, 9/10/11/36/70/82/180/200/214, 9/10/11/36/70/82/180/200/214/229, 9/10/11/38/70/82/180/186/200/214, 9/10/11/40/70/82/180/200/214, 9/10/11/49/51/54/70/82/87/108/110/148/180/219, 9/10/11/49/51/54/70/82/87/108/180, 9/10/11/49/51/54/70/82/110/148/180, 9/10/11/49/51/70/82/108/110/148/180, 9/10/11/49/54/70/82/87/148/180, 9/10/11/49/70/82/87/108/110/180/200, 9/10/11/49/70/82/87/180, 9/10/11/49/70/82/110/148/180/225, 9/10/11/51/54/70/73/82/108/110/180, 9/10/11/51/54/70/73/82/108/180/200/225, 9/10/11/51/54/70/73/82/110/148/180, 9/10/11/51/54/70/82/148/180, 9/10/11/51/70/82/110/180/192/219, 9/10/11/54/70/

82/87/108/180, 9/10/11/54/70/82/87/180/192, 9/10/11/54/70/82/148/180/200, 9/10/11/54/70/82/180/200/214, 9/10/11/70, 9/10/11/70/71/82/180/200/214, 9/10/11/70/73/82/87/110/180, 9/10/11/70/73/82/108/148/180, 9/10/11/70/73/82/148/180, 9/10/11/70/73/82/148/180/192/200, 9/10/11/70/73/82/180/200/214, 9/10/11/70/82, 9/10/11/70/82/87/110/180/219, 9/10/11/70/82/100/180/200/214, 9/10/11/70/82/107, 9/10/11/70/82/108/180/200/214, 9/10/11/70/82/148/180, 9/10/11/70/82/148/180/200/214, 9/10/11/70/82/180, 9/10/11/70/82/180/200/214, 9/10/11/70/87/180/200/214, 9/10/11/70/107, 9/10/12/49/51/54/70/82/108/148/180/225, 9/10/12/51/54/70/180/225, 9/10/12/51/70/73/82/148/180/200, 9/10/12/70/82/148/180/225, 9/10/12/70/82/180/200/214, 9/10/13/70, 9/10/13/70/82, 9/10/13/70/229, 9/10/13/207, 9/10/17, 9/10/17/49/51/54/70/73/82/108/110/148/180/192/200/219, 9/10/17/49/51/54/70/82/87/180/219, 9/10/17/49/70/82/148/180, 9/10/17/51/54/70/82/87/108/110/180/200, 9/10/17/51/70/73/82/87/108/110/148/180/219, 9/10/17/54/70/73/82/87/108/110/148/180/200, 9/10/17/54/70/73/82/108/110/148/180, 9/10/17/54/70/82/87/108/110/180, 9/10/17/70/73/82/87/180/219, 9/10/17/70/73/82/108/110/148/180/200, 9/10/17/70/82/87/148/180, 9/10/17/70/82/87/148/180/192/219, 9/10/17/70/82/108/148/180, 9/10/17/70/82/110/148/180, 9/10/17/70/82/110/148/180/200, 9/10/17/70/82/180/200/214, 9/10/17/70/104/160/165, 9/10/17/70/139/160/165, 9/10/26, 9/10/29/70, 9/10/36/70/82/180/200/214, 9/10/37, 9/10/38/70/82/180/200/214, 9/10/39, 9/10/39/186, 9/10/41, 9/10/45/70, 9/10/49/51/54/70/73/82/108/110/148/180/192, 9/10/49/51/54/70/73/82/148/180, 9/10/49/51/54/70/82/108/110/148/180/225, 9/10/49/51/54/70/82/110/148/180, 9/10/49/51/54/70/82/110/180, 9/10/49/51/54/70/82/148/180, 9/10/49/51/54/70/82/148/180/192, 9/10/49/51/70/82/108/148/180/219, 9/10/49/51/70/82/110/148/180, 9/10/49/51/70/82/180/225, 9/10/49/54/70/73/82/87/110/180, 9/10/49/54/70/82/87/110/180, 9/10/49/54/70/82/108/148/180/225, 9/10/49/70/73/82/87/108/148/180, 9/10/49/70/73/82/108/110/148/180/225, 9/10/49/70/82/87/148/180, 9/10/49/70/82/110/180/219, 9/10/51/54/70/73/82/108/180, 9/10/51/54/70/73/82/110/148/180, 9/10/51/54/70/73/82/110/180, 9/10/51/54/70/73/82/180/219, 9/10/51/54/70/73/82/180/225, 9/10/51/54/70/82/87/180, 9/10/51/54/70/82/148/180, 9/10/51/54/70/82/180, 9/10/51/54/70/82/180/200, 9/10/51/70/82/108/180, 9/10/51/70/82/110/180/200, 9/10/51/70/82/180/219, 9/10/54/70/73/82/108/148/180/192, 9/10/54/70/82/87/108/180/200, 9/10/54/70/82/180, 9/10/62, 9/10/70, 9/10/70/73/82/87/108/110/180, 9/10/70/73/82/87/180/192/219, 9/10/70/73/82/87/180/200, 9/10/70/73/82/108/110/148/180, 9/10/70/73/82/108/110/180/200/219, 9/10/70/73/82/108/148/180, 9/10/70/73/82/108/148/180/192, 9/10/70/73/82/108/148/180/192/219, 9/10/70/73/82/108/180, 9/10/70/73/82/148/180, 9/10/70/73/82/148/180/200, 9/10/70/73/82/180/192, 9/10/70/73/82/180/192/219, 9/10/70/82, 9/10/70/82/87/108/110/148/180/192/219, 9/10/70/82/87/108/110/180, 9/10/70/82/87/108/110/180/192, 9/10/70/82/87/180, 9/10/70/82/107, 9/10/70/82/107/229, 9/10/70/82/108/110/180/219, 9/10/70/82/108/180, 9/10/70/82/110/148/180, 9/10/70/82/110/180/219, 9/10/70/82/148/180, 9/10/70/82/148/180/200, 9/10/70/82/148/180/200/219, 9/10/70/82/180, 9/10/70/82/180/192/219, 9/10/70/82/180/200/214, 9/10/70/82/229, 9/10/70/92, 9/10/70/99, 9/10/70/99/229, 9/10/70/107/229, 9/10/70/156, 9/10/70/165, 9/10/70/229, 9/10/88, 9/10/90, 9/10/96, 9/10/107, 9/10/110, 9/10/111, 9/10/112, 9/10/133, 9/10/178, 9/10/185, 9/10/186, 9/10/196, 9/10/211, 9/10/226, 11/24, 11/24/219, and 11/36/206/208, wherein the amino acid positions of said polypeptide sequence are numbered with reference to SEQ ID NO: 536.

7. The engineered carboxyesterase of claim 1, wherein said polypeptide sequence is selected from the even-numbered sequence identifiers of: SEQ ID NOs: 6-160, 164-194, 198-228, 232-240, 246-262, 266-274, 278, 286-298, 300-310, 314-322, 326, 328, 332-348, 352, 356-374, 378-392, 398-408, 412, 416-444, 450, 452, 456-462, 466-470, 474-480, 484-490, 494, 496, 502-506, 510-516, 520, 524, 528-532 and 536.

8. The engineered carboxyesterase of claim 1, wherein said improved property is selected from: improved hydrolysis activity, solvent tolerance, thermostability, pH stability, enantioselectivity, regioselectivity, stereoselectivity, substrate scope, and/or reduced substrate or product inhibition, and reduced toxicity to bacterial host cells producing said engineered carboxyesterase.

9. The engineered carboxyesterase of claim 8, wherein said bacterial host cells comprise *E. coli.*

10. The engineered carboxyesterase of claim 1, wherein said engineered carboxyesterase exhibits greater activity than wild-type *Xanthomonas campestris* carboxyesterase in the conversion of compound (2a)

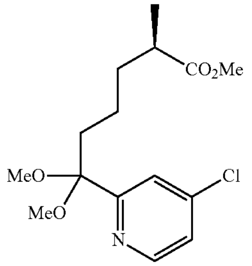 [SMILES: COC(=O)[C@H](C)CCCC(OC)(OC)c1cc(Cl)ccn1]

to compound (3a)

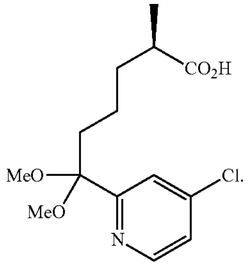

11. The engineered carboxyesterase of claim 1, wherein said engineered carboxyesterase exhibits greater enantioselectivity than wild-type *Xanthomonas campestris* carboxyesterase in the conversion of compound (2a)

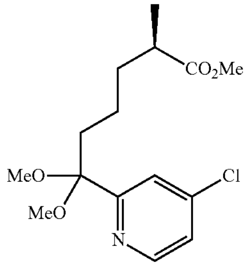 [SMILES: COC(=O)[C@H](C)CCCC(OC)(OC)c1cc(Cl)ccn1]

to compound (3a)

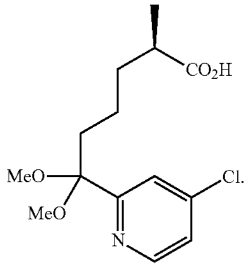

12. The engineered carboxyesterase of claim 1, wherein said engineered carboxyesterase is purified.

13. The engineered carboxyesterase of claim 1, wherein said engineered carboxyesterase is immobilized.

14. A composition comprising at least one engineered carboxyesterase of claim 1.

15. A polynucleotide sequence encoding at least one engineered carboxyesterase of claim 1.

16. The polynucleotide sequence of claim 15, wherein said polynucleotide sequence is operably linked to a control sequence.

17. The polynucleotide sequence of claim 15, wherein said polynucleotide sequence is codon optimized.

18. An expression vector comprising at least one polynucleotide sequence of claim 15.

19. A host cell comprising at least one expression vector of claim 18.

20. A host cell comprising at least one polynucleotide sequence of claim 15.

21. The host cell of claim 19, wherein said host cell is *E. coli.*

22. A method of producing an engineered carboxyesterase in a host cell, comprising culturing the host cell of claim 19, under suitable conditions, such that at least one engineered carboxyesterase is produced.

23. The method of claim 22, further comprising recovering at least one engineered carboxyesterase from the culture and/or host cell.

24. The method of claim 23, further comprising the step of purifying said at least one engineered carboxyesterase.

* * * * *